(12) United States Patent
Giver et al.

(10) Patent No.: US 7,879,585 B2
(45) Date of Patent: Feb. 1, 2011

(54) KETOREDUCTASE ENZYMES AND USES THEREOF

(75) Inventors: Lorraine Joan Giver, Sunnyvale, CA (US); Lisa Marie Newman, San Jose, CA (US); Emily Mundorff, Belmont, CA (US); Gjalt W. Huisman, San Carlos, CA (US); Stephane J. Jenne, Foster City, CA (US); Jun Zhu, Sunnyvale, CA (US); Behnaz Behrouzian, Sunnyvale, CA (US); John H. Grate, Los Altos, CA (US); James Lalonde, Palo Alto, CA (US)

(73) Assignee: Codexis, Inc., Redwood City, CA (US)

( * ) Notice: Subject to any disclaimer, the term of this patent is extended or adjusted under 35 U.S.C. 154(b) by 0 days.

(21) Appl. No.: 11/865,696

(22) Filed: Oct. 1, 2007

(65) Prior Publication Data
US 2008/0248539 A1    Oct. 9, 2008

Related U.S. Application Data

(60) Provisional application No. 60/848,951, filed on Oct. 2, 2006.

(51) Int. Cl.
*C12P 1/00* (2006.01)
*C12P 7/62* (2006.01)
*C12N 9/02* (2006.01)
*C12N 9/04* (2006.01)
*C12N 1/20* (2006.01)
*C07H 21/04* (2006.01)

(52) U.S. Cl. .......... 435/135; 435/41; 435/189; 435/190; 435/252.33; 536/23.2

(58) Field of Classification Search .......... None
See application file for complete search history.

(56) References Cited

U.S. PATENT DOCUMENTS

| | | | |
|---|---|---|---|
| 4,962,031 A | 10/1990 | Yoshida et al. |
| 5,097,045 A | 3/1992 | Butler et al. |
| 5,155,251 A | 10/1992 | Butler et al. |
| 5,200,335 A | 4/1993 | Hummel et al. |
| 5,225,339 A | 7/1993 | Wong et al. |
| 5,273,995 A | 12/1993 | Roth |
| 5,278,313 A | 1/1994 | Thottathil et al. |
| 5,342,767 A | 8/1994 | Wong et al. |
| 5,385,833 A | 1/1995 | Bradshaw et al. |
| 5,413,921 A | 5/1995 | Onishi et al. |
| 5,427,933 A | 6/1995 | Chen et al. |
| 5,491,077 A | 2/1996 | Chartrain et al. |
| 5,559,030 A | 9/1996 | Matsuyama et al. |
| 5,700,670 A | 12/1997 | Yamagishi et al. |
| 5,891,685 A | 4/1999 | Yamagishi et al. |
| 5,969,156 A | 10/1999 | Briggs et al. |
| 6,001,615 A | 12/1999 | Reeve |
| 6,001,618 A | 12/1999 | Kimoto et al. |
| 6,037,158 A | 3/2000 | Hummel et al. |
| 6,168,935 B1 | 1/2001 | Yamamoto |
| 6,218,156 B1 | 4/2001 | Yasohara et al. |
| 6,225,099 B1 | 5/2001 | Hummel et al. |
| 6,344,569 B1 | 2/2002 | Mitsuda et al. |
| 6,399,339 B1 | 6/2002 | Wolberg et al. |
| 6,413,750 B1 | 7/2002 | Hummel et al. |
| 6,433,213 B1 | 8/2002 | Bosch et al. |
| 6,472,544 B1 | 10/2002 | Kizaki et al. |
| 6,596,879 B2 | 7/2003 | Bosch et al. |
| 6,645,746 B1 | 11/2003 | Kizaki et al. |
| 6,689,591 B2 | 2/2004 | Muller et al. |
| 6,800,477 B2 | 10/2004 | Patel et al. |
| 6,867,306 B2 | 3/2005 | Srinath et al. |
| 7,083,962 B2 | 8/2006 | Kimoto et al. |
| 2002/0061564 A1 | 5/2002 | Rozzell |
| 2003/0040634 A1 | 2/2003 | Kizaki et al. |
| 2003/0054520 A1 | 3/2003 | Bommanus et al. |
| 2003/0068811 A1 | 4/2003 | Patel et al. |
| 2004/0265978 A1 | 12/2004 | Gupta et al. |
| 2005/0095619 A1 | 5/2005 | Davis et al. |
| 2005/0153417 A1 | 7/2005 | Davis et al. |
| 2005/0202545 A1 | 9/2005 | Ishihara et al. |
| 2006/0195947 A1 | 8/2006 | Davis et al. |
| 2006/0286646 A1 | 12/2006 | Patel et al. |
| 2007/0212766 A1 | 9/2007 | Pfaller et al. |
| 2008/0233619 A1 | 9/2008 | Gupta et al. |
| 2008/0248539 A1 | 10/2008 | Giver et al. |
| 2008/0261286 A1 | 10/2008 | Ishihara et al. |

(Continued)

FOREIGN PATENT DOCUMENTS

CN    101260415    9/2008

(Continued)

OTHER PUBLICATIONS

Chica et al. Curr Opin Biotechnol. Aug. 2005;16(4):378-84.*

(Continued)

*Primary Examiner*—Christian L Fronda

(57) ABSTRACT

The present disclosure provides ketoreductase enzymes having improved properties as compared to a naturally occurring wild-type ketoreductase enzyme. Also provided are polynucleotides encoding the engineered ketoreductase enzymes, host cells capable of expressing the engineered ketoreductase enzymes, method of using the engineered ketoreductase enzymes to synthesize a variety of chirally pure compounds, and the chirally pure compounds prepared therewith.

39 Claims, 10 Drawing Sheets

U.S. PATENT DOCUMENTS

| | | | |
|---|---|---|---|
| 2008/0318295 | A1 | 12/2008 | Ching et al. |
| 2009/0093031 | A1 | 4/2009 | Liang et al. |
| 2009/0311762 | A1 | 12/2009 | Tschentscher et al. |

FOREIGN PATENT DOCUMENTS

| | | |
|---|---|---|
| CN | 101319236 | 12/2008 |
| EP | 0 796 914 A2 | 9/1997 |
| EP | 1 013 758 A2 | 6/2000 |
| EP | 1 832 658 A1 | 9/2007 |
| IN | 532/DEL/2006 | 10/2007 |
| JP | 60251890 A | 12/1985 |
| JP | 1723728 C | 7/1986 |
| JP | 63304979 A | 12/1988 |
| JP | 63309195 A | 12/1988 |
| JP | 01060391 A | 3/1989 |
| JP | 2001292790 A | 10/2001 |
| JP | 2002209592 A | 7/2002 |
| JP | 2005218348 | 8/2005 |
| JP | 2009225773 A | 10/2009 |
| WO | WO 93/18138 | 9/1993 |
| WO | WO 98/35025 | 8/1998 |
| WO | WO 01/40450 A1 | 6/2001 |
| WO | WO 01/85975 A1 | 11/2001 |
| WO | WO 02/086126 A2 | 10/2002 |
| WO | WO 03/004653 A1 | 1/2003 |
| WO | WO 03/070733 A1 | 8/2003 |
| WO | WO 2004/017135 A2 | 2/2004 |
| WO | WO 2004/111083 A2 | 12/2004 |
| WO | WO 2004/113314 A1 | 12/2004 |
| WO | WO 2005/017135 A1 | 2/2005 |
| WO | WO 2005/018579 A2 | 3/2005 |
| WO | WO 2005/033094 A2 | 4/2005 |
| WO | WO 2005/054491 A1 | 6/2005 |
| WO | WO 2006/087235 A1 | 8/2006 |
| WO | WO 2007/012428 A1 | 2/2007 |
| WO | WO 2007/036257 A1 | 4/2007 |
| WO | WO 2008/042876 A2 | 4/2008 |
| WO | WO 2008/059366 A2 | 5/2008 |
| WO | WO 2008/103248 A1 | 8/2008 |

OTHER PUBLICATIONS

Sen et al. Appl Biochem Biotechnol. Dec. 2007;143(3):212-23.*
Amidjojo et al., 2005, "Asymmetric Synthesis of Telt-butyl (3R, 5S) 6-chloro-dihydroxyhexanoate with *Lactobacillus kefir*," *Appl Microbiol Biotechnol.*, 69:9-15.
Baerga-Ortiz et al., 2006, "Directed Mutagenesis Alters the Stereochemistry of Catalysis by Isolated Ketoreductase Domains from the Erythromycin Polyketide Synthase," *Chem Biol.*, 13(3):277-85.
Genbank Acc. NP010159.1.
Genbank Accession Q07551, Nov. 1996.
O'Hare et al., 2006, "High-Throughput Mutagenesis to Evaluate Models of Stereochemical Control in Ketoreductase Domains from the Erythromycin Polyketide Synthase," *Chem Biol.*, 13(3):287-96.
PCT International Search Report from PCT/US2007/080125 dated Sep. 26, 2008.
Petrash et al., 2001, "Functional Genomic Studies of Aldo-keto Reductases," *Chem Biol Interact.*, 130-132(1-3):673-83.
Singapore Search Report and Written Opinion from Application No. 200901677-5, issued on Sep. 28, 2009.
Bisel et al., 2007, "Stereochemical clarification of the enzyme-catalysed reduction of 2-acetylchromen-4-one," *Tetrahedron Asymmetry*, 18(9):1142-1144.

Bradshaw et al., 1992, "*Lactobacillus kefir* Alcohol Dehydrogenase: A Useful Catalyst for Synthesis," *J. Org. Chem.* 57(5):1532-1536.
Breyer-Pfaff et al., 1999, "High-affinity Stereoselective Reduction of the Enantiomers of Ketotifen and of Ketonic Nortriptyline Metabolites by Aldo-Keto Reductases from Human Liver," *Biochem. Pharmacol.*, 59:249-260.
Cha et al., 2002, "Stereochemical control in diastereoselective reduction of α-substituted-β-ketoesters using a reductase purified from *Kluyveromyces marxianus*," *Biotechnol. Lett*, 24:1695-1698.
Database EPO Proteins, Apr. 2007, "Sequence 4 from Patent WO2007012428," XP002488479, retrieved from EBI Accession No. EPOP:CS 539287, Database Accession No. CS539287.
Fuganti et al., 1993, "Microbial Generation of (2R,3S)- and (2S,3S)-Ethyl 2-Benzamidomethyl-3-hydroxybutyrate, a Key Intermediate in the Synthesis of (3S,1'R)-3-(1'-Hydroxyethyl)azetidin-2-one," *J Chem. Soc. Perkin Trans.* 1:2247-2249.
Genbank Accession No. 1NXQ_A.
Genbank Accession No. AAP94029.
Genbank Accession No. AJ544275.
Genbank Accession No. BAA24528.1.
Genbank Accession No. CAD66648.
Genbank Accession No. JC7338.
Genbank Accession No. P41747.
Goldberg et al., 2007, "Biocatalytic ketone reduction-a powerful tool for the production of chiral alcohols-part I: processes with isolated enzymes," *Appl Microbiol Biotechnol*, 76(2):237-248.
Gröger et al., 2004, "Preparative asymmetric reduction of ketones in a biphasic medium with an (S)-alcohol dehydrogenase under in situ-cofactor-recycling with a formate dehydrogenase," *Tetrahedron* 60:633-640.
Hönig et al., 1994, "Enzymatic Resolutions of Heterocyclic Alcohols," *Biocatalysis* 9:61-69.
Hummel, 1990, "Reduction of acetophenone to R(+)-phenylethanol by a new alcohol dehydrogenase from *Lactobacillus kefir*," *Appl Microbiol Biotechnol*, 34(I): 15-19.
Hummel, 1999, "Large-scale applications of NAD(P)-dependent oxidoreductases: recent developments," *Trends Biotechnol.* 17(12):487-492.
Jones et al., 1981, "Enzymes in organic syntheses. 19.[1] Evaluation of the stereoselectivities of horse liver alcohol dehydrogenase; catalyzed oxidoreductions of hydroxy- and ketothiolanes, -thianes, and -thiepanes," *Can. J. Chem.*, 59:1574-1579.
Jörnvall et al., 1995, "Short-Chain Dehydrogenase/Reductases (SDR)," *Biochemistry* 34(18):6003-6013.
Kallberg et al., 2002, "Short-chain dehydrogenase/reductase (SDR) relationships: A large family with eight clusters common to human, animal, and plant genomes," *Protein Sci.* 11(3):636-641.
Kallberg et al., 2002, "Short-chain dehydrogenases/reductases (SDRs) Coenzyme-based functional assignments in completed genomes," *Eur. J. Biochem.* 269:4409-4417.
Niefind et al., 2003, "The Crystal Structure of R-specific Alcohol Dehydrogenase from *Lactobacillus brevis* Suggests the Structural Basis of its Metal Dependency," *J Mol Bio.* 327(2):317-328.
Rodrigues et al., 2004, "Recent Advances in the Biocatalytic Asymmetric Reduction of Acetophenones and α,β-Unsaturated Carbonyl Compounds," *Food Technol. Biotechnol.* 42 (4) 295-303.
Schlieben et al., 2005, "Atomic Resolution Structures of R-specific Alcohol Dehydrogenase from *Lactobacillus brevis* Provide the Structural Bases of its Substrate and Cosubstrate Specificity," *J. Mol. Biol.* 349(4):801-13.
Shimoda et al., 2006, "Diastereoselective reduction of β-keto carbonyl compounds by cultured plant cells," *Tetrahedron Lett.* 47(10):1541-1544.
Temiño et al., 2005, "Entrapment of the alcohol dehydrogenase from *Lactobacillus kefir* in polyvinyl alcohol for the synthesis of chiral hydrophobic alcohols in organic solvents," *Enzyme Microb. Technol.*, 36(1):3-9.
Thayer, 2006, "Competitors Want to Get a Piece of Lipitor," *Chem. Eng. News*, 84(33):26-27.
Weckbecker et al., 2006, "Cloning, expression, and characterization of an (R)-specific alcohol dehydrogenase from *Lactobacillus kefir*," *Biocatal. Biotransform.*, 24(5):380-389.

Wolberg et al., 2000, "Highly Regio- and Enantioselective Reduction of 3,5-Dioxocarboxylates," *Angew Chem. Int. Ed. Engl.* 39(23):4306-4308.

Wolberg, 2001, "Enzymatic Reduction of Hydrophobic beta, delta-Diketo Esters," *Synthesis* 937-942.

Xie et al., 2006, "Asymmetric Reduction of *o*-Chloroacetophenone with *Candida pseudotropicalis* 104," *Biotechnol. Prog.* 22(5):1301-1304.

Zhou et al., 1983, "Stereochemical Control of Yeast Reductions. 1. Asymmetric Synthesis of L-Carnitine," *J. Am. Chem. Soc.*, 105:5925-5926.

Zhu et al., 2005, "Evaluation of substituent effects on activity and enantioselectivity in the enzymatic reduction of aryl ketones," *Tetrahedron Asymm.* 16:1541-1546.

* cited by examiner

```
Met Ser Phe His Gln Gln Phe Phe Thr Leu Asn Asn Gly Asn Lys Ile
1               5                   10                  15
Pro Ala Ile Ala Ile Ile Gly Thr Gly Thr Arg Trp Tyr Lys Asn Glu
            20                  25                  30
Glu Thr Asp Ala Thr Phe Ser Asn Ser Leu Val Glu Gln Ile Val Tyr
            35                  40                  45
Ala Leu Lys Leu Pro Gly Ile Ile His Ile Asp Ala Ala Glu Ile Tyr
        50                  55                  60
Arg Thr Tyr Pro Glu Val Gly Lys Ala Leu Ser Leu Thr Glu Lys Pro
65                  70                  75                  80
Arg Asn Ala Ile Phe Leu Thr Asp Lys Tyr Ser Pro Gln Ile Lys Met
                85                  90                  95
Ser Asp Ser Pro Ala Asp Gly Leu Asp Leu Ala Leu Lys Lys Met Gly
            100                 105                 110
Thr Asp Tyr Val Asp Leu Tyr Leu Leu His Ser Pro Phe Val Ser Lys
            115                 120                 125
Glu Val Asn Gly Leu Ser Leu Glu Glu Ala Trp Lys Asp Met Glu Gln
    130                 135                 140
Leu Tyr Lys Ser Gly Lys Ala Lys Asn Ile Gly Val Ser Asn Phe Ala
145                 150                 155                 160
Val Glu Asp Leu Gln Arg Ile Leu Lys Val Ala Glu Val Lys Pro Gln
                165                 170                 175
Val Asn Gln Ile Glu Phe Ser Pro Phe Leu Gln Asn Gln Thr Pro Gly
                180                 185                 190
Ile Tyr Lys Phe Cys Gln Glu His Asp Ile Leu Val Glu Ala Tyr Ser
            195                 200                 205
Pro Leu Gly Pro Leu Gln Lys Lys Thr Ala Gln Asp Asp Ser Gln Pro
    210                 215                 220
Phe Phe Glu Tyr Val Lys Glu Leu Ser Glu Lys Tyr Ile Lys Ser Glu
225                 230                 235                 240
Ala Gln Ile Ile Leu Arg Trp Val Thr Lys Arg Gly Val Leu Pro Val
                245                 250                 255
Thr Thr Ser Ser Lys Pro Gln Arg Ile Ser Asp Ala Gln Asn Leu Phe
            260                 265                 270
Ser Phe Asp Leu Thr Ala Glu Glu Val Asp Lys Ile Thr Glu Leu Gly
        275                 280                 285
Leu Glu His Glu Pro Leu Arg Leu Tyr Trp Asn Lys Leu Tyr Gly Lys
    290                 295                 300
Tyr Asn Tyr Ala Ala Gln Lys Val Ter
305                 310
```

Oil prepared by the method of Example 17.

Oil prepared from commercial crystalline t-butyl (6R)-(2-cyanoethyl)-2,2 dimethyl-1,3-dioxane-(4R)-acetate.

LC/MS/MS chromatograms of t-butyl 6-cyano-(3R,5R)-dihydroxyhexanoate samples of Example 27.

KETOREDUCTASE ENZYMES AND USES THEREOF

1. CROSS-REFERENCE TO RELATED APPLICATIONS

The present application claims benefit under 35 U.S.C. §119(e) of U.S. application Ser. No. 60/848,951, filed on Oct. 2, 2006, which is hereby incorporated by reference in its entirety.

2. TECHNICAL FIELD

The present disclosure relates to compositions and methods useful for the stereoselective reduction of hydroxy oxo esters, such as 5-hydroxy-3-oxo-hexanoate esters, to yield stereoisomerically pure corresponding syn dihydroxy esters. More specifically, the disclosure concerns non-naturally occurring engineered ketoreductase enzymes having improved properties as compared to the wild-type ketoreductases from which they were derived, polynucleotides encoding the engineered ketoreductase enzymes, host cells comprising such polynucleotides, methods of using the engineered ketoreductase enzymes to synthesize a variety of stereoisomerically pure compounds, and the stereoisomerically pure compounds synthesized therewith.

3. REFERENCE TO SEQUENCE LISTING, TABLE OR COMPUTER PROGRAM

The Sequence Listing submitted electronically via EFS-WEB pursuant to 37 C.F.R. §§1.821(c) and 1.821(e) in computer readable form (CRF) as file name 376247-012US.txt, created on May 30, 2008 and having a file size of 716 Kbytes, is herein incorporated by reference in its entirety.

4. BACKGROUND

Stereoisomerically pure syn 3,5-dihydroxyhexanoate esters are key chiral intermediates for the synthesis of cholesterol lowering statins such as atorvastatin calcium (sold under the brand name LIPITOR® by Pfizer, Inc.), rosuvastatin calcium (sold under the brand name CRESTOR® by AstraZeneca, Ltd.), and pitavastatin (sold in Japan under the brand name Lipalo by Kowa Company Ltd. and Nissan Chemical Industries). While various methods for producing these chiral intermediates are known, including both chemical and enzymatic methods of reducing the corresponding 5-hydroxy-3-oxohexanoate ester, these methods suffer significant drawbacks, making them less than ideal for commercial scale synthesis. Given the importance of these key chiral intermediates in the synthesis of cholesterol lowering statins, compositions and methods useful for synthesizing these compounds in a cost effective and efficient manner would be highly desirable.

5. SUMMARY

As mentioned above, stereoisomerically pure syn 3,5-dihydroxyhexanoate esters according to structural formula (IIa):

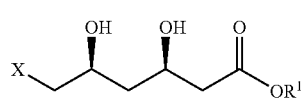

(IIa)

wherein X is selected from halo (e.g., chloro and bromo), cyano and —OR$^6$, where R$^6$ is hydrogen or a protecting group, and R$^1$ is selected from (C2-C12) alkyl, (C6-C10) aryl and (C7-C12) arylalkyl, are key intermediates in the synthesis of cholesterol lowering statins, including but not limited to, atorvastatin; rosuvastatin, and pitavastatin. These key chiral intermediates are typically synthesized by reducing the corresponding enantiomerically pure 5-hydroxy-3-oxohexanoate ester according to structural formula (Ia):

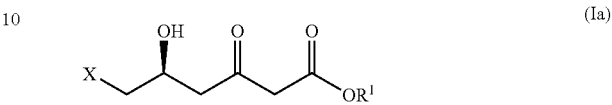

(Ia)

under conditions in which the syn dihydroxy ester diastereomer of structural formula (IIa), supra, is obtained in diastereomeric excess over the corresponding anti dihydroxy ester diastereomer of structural formula (IIb):

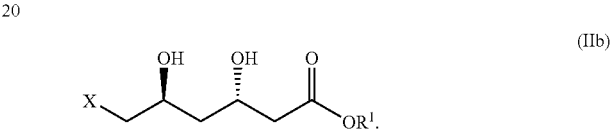

(IIb)

Recently, certain ketoreductase enzymes have been identified that can be used to carry out this enantioselective reduction (see, e.g., U.S. Pat. No. 6,645,746 and WO 01/40450). The present inventors have discovered that ketoreductase enzymes capable of catalyzing the above-described enantioselective reduction can be engineered using laboratory evolution technologies, such as DNA shuffling, to yield non-naturally occurring engineered ketoreductases that have improved properties as compared to the naturally-occurring wild-type ketoreductase enzyme obtained from *Saccharomyces cerevisiae*. Further, the disclosure also provides isolated naturally-occurring ketoreductases that comprise any one of the sets of mutations disclosed herein for the engineered ketoreductases. Thus, such naturally-occurring ketoreductases that comprise such sets of mutations can be used in any one of the processes, kits, reaction mixtures, etc. disclosed herein.

The improved properties can be related to different aspects of the wild-type ketoreductase enzyme. For example, the improved properties can involve the stability of the enzyme under the conditions of the stereoselective reduction reaction, the enzymatic activity of the ketoreductase enzyme, and/or sensitivity to inhibition (e.g., product inhibition).

Thus, in one aspect, the present disclosure provides engineered (or isolated naturally-occurring variant) ketoreductase enzymes having an improved property as compared to the naturally-occurring wild-type ketoreductase enzyme obtained from *Saccharomyces cerevisiae*. The engineered ketoreductases can possess a single improved property, or they can possess two or more improved properties, in any combination(s). In some aspects, the engineered ketoreductases can comprise an amino acid sequence that is at least 90%, 91%, 92%, 93%, 94%, 95%, 96%, 97%, 98%, or 99% identical to the wild-type ketoreductase enzyme amino acid sequence, with the proviso that the engineered amino acid sequence comprises one or more mutations that are sufficient to provide an improved property.

In some embodiments, the engineered ketoreductase enzyme has increased enzymatic activity as compared to the wild-type ketoreductase enzyme. Improvements in enzymatic activity can be measured by comparing the specific activity of the engineered ketoreductase with that of the wild-type ketoreductase enzyme using standard enzyme assays. The amount of the improvement can range from 1.5 times the enzymatic activity of the corresponding wild-type ketoreductase enzyme, to as much as 2 times. 5 times, 10 times, 20 times, 25 times, 50 times, 75 times, 100 times, 150 times, 200 times, 250 times, 300 times, or more enzymatic activity. In specific embodiments, the engineered ketoreductase enzyme exhibits improved enzymatic activity in the range of 1.5 to 50 times, 1.5 to 100 times, 1.5 to 150 times, 1.5 to 200 times, 1.5 to 250 times, or 1.5 to 300 times greater than that of the wild-type ketoreductase enzyme. Improvements in enzyme activity also include increases in stereoselectivity or reduced product inhibition.

In some embodiments, the engineered ketoreductase enzyme exhibits improved thermal stability as compared to the wild-type ketoreductase enzyme. Improvements in thermal stability can be measured by comparing the degree of enzymatic activity retained by the engineered ketoreductase enzyme following a specified period of incubation at a specified temperature with that retained by the corresponding wild-type enzyme under similar conditions.

The engineered ketoreductase enzymes described herein can be obtained by mutagenizing the gene encoding naturally-occurring wild-type ketoreductase enzyme of *Saccharomyces* utilizing standard laboratory techniques, including the various mutagenesis and recombination techniques.

In some embodiments, the engineered ketoreductase enzymes described herein have a sequence that corresponds to the amino acid sequence of the wild-type ketoreductase from which they are derived and include one or more amino acid mutations that result in an improvement in the property of the enzyme. In some embodiments, the mutations are a selected combination of mutations that overall improve one or more properties of the enzyme. In some embodiments, such as where the improved property is from a single mutation or specific combination of mutations, the engineered ketoreductase may optionally include one or more conservative mutations at other residue positions within the polypeptide sequence.

In some embodiments, the ketoreductase enzyme comprises an amino acid sequence that corresponds to SEQ ID NO:2, or is at least about 90%, 91%, 92%, 93%, 94%, 95%, 96%, 97%, 98%, or 99% identical to SEQ ID NO:2, and wherein the amino acid sequence comprises at least one mutation over SEQ ID NO:2 at one of the following residue positions: 6, 27, 31, 36, 48, 63, 65, 86, 125, 152, 160, 165, 194, 214, 218, 234, 248, 250, 263, 290, 296, 297, 301, and 307. In one embodiment, the at least one mutation at one of the above positions must be a non-conservative mutation as compared to the wild-type SEQ ID NO:2 sequence.

In some embodiments, the ketoreductase enzyme comprises an amino acid sequence that corresponds to SEQ ID NO:2, or is at least about 90%, 91%, 92%, 93%, 94%, 95%, 96%, 97%, 98%, or 99% identical to SEQ ID NO:2, and wherein the amino acid sequence comprises an aromatic residue at position 63. In one embodiment, the aromatic residue is tryptophan.

In some embodiments, the ketoreductase enzyme has an amino acid sequence that is at least about 80, 85, 90, 91, 92, 93, 94, 95, 96, 97, 98, or 99% identical to any one of the amino acid sequences listed in the Sequence Listing, with the proviso that the amino acid sequence is not identical to the wild-type sequence (SEQ ID NO:2). In some embodiments, the ketoreductase has an amino acid sequence that is identical to any one of the amino acid sequences listed in the Sequence Listing and includes one or more conservative mutations (including for example, 1, 2, 3, 1-5, 1-10-, 1-20, or more conservative mutations).

In some embodiments, the ketoreductase comprises an amino acid sequence that corresponds to SEQ ID NO:2, or is at least about 90, 91, 92, 93, 94, 95, 96, 97, 98, or 99% identical to SEQ ID NO:2, and comprises one or more of the following characteristics:

$X^6$ is a polar or acidic amino acid residue;
$X^{27}$ is an aliphatic or basic amino acid residue;
$X^{31}$ is a hydroxyl containing or aliphatic amino acid residue;
$X^{36}$ is a small amino acid residue;
$X^{48}$ is a basic amino acid residue;
$X^{63}$ is a hydrophobic or aromatic amino acid;
$X^{65}$ is a hydroxyl containing or small amino acid residue;
$X^{86}$ is an aliphatic or hydrophobic amino acid residue;
$X^{125}$ is an aliphatic or aromatic amino acid residue;
$X^{152}$ is a basic amino acid residue;
$X^{160}$ is a hydroxyl containing or small amino acid residue;
$X^{165}$ is a polar or acidic amino acid residue;
$X^{194}$ is an aromatic amino acid or polar hydrophilic amino acid residue
$X^{214}$ is a polar hydrophilic amino acid residue;
$X^{218}$ is a hydroxyl containing amino acid residue;
$X^{234}$ is a polar hydrophilic amino acid residue;
$X^{248}$ is an aliphatic amino acid residue;
$X^{250}$ is a basic amino acid residue;
$X^{263}$ is a acidic or polar amino acid residue;
$X^{290}$ is an acidic amino acid residue;
$X^{296}$ is an aliphatic amino acid residue
$X^{297}$ is an aromatic amino acid residue;
$X^{301}$ is an aliphatic or hydroxyl containing or acidic or hydrophilic or basic amino acid residue; and
$X^{307}$ is an aromatic, a polar or a hydroxyl containing amino acid residue. In one embodiment, the ketoreductase comprises all of the above characteristics. In one embodiment, the ketoreductase comprises at least one characteristic such that at least one residue is mutated as compared to SEQ ID NO:2. In one embodiment, the ketoreductase comprises at least one characteristic such that at least one residue is non-conservatively mutated as compared to SEQ ID NO:2.

In some embodiments, the ketoreductase enzyme comprises an amino acid sequence that corresponds to SEQ ID NO:2, or is at least about 90, 91, 92, 93, 94, 95, 96, 97, 98, or 99% identical to SEQ ID NO:2, and comprises one or more of the following characteristics:

$X^6$ is a polar or acidic amino acid residue;
$X^{27}$ is an aliphatic or basic amino acid residue;
$X^{31}$ is a hydroxyl containing or aliphatic amino acid residue;
$X^{36}$ is a small amino acid residue;
$X^{48}$ is a basic amino acid residue;
$X^{63}$ is an aromatic amino acid;
$X^{65}$ is a hydroxyl containing or small amino acid residue;
$X^{86}$ is an aliphatic or hydrophobic amino acid residue;
$X^{125}$ is an aliphatic or aromatic amino acid residue;
$X^{152}$ is a basic amino acid residue;
$X^{160}$ is a hydroxyl containing or small amino acid residue;
$X^{165}$ is a polar or acidic amino acid residue;
$X^{194}$ is an aromatic amino acid or polar hydrophilic amino acid residue
$X^{214}$ is a polar hydrophilic amino acid residue;
$X^{218}$ is a hydroxyl containing amino acid residue;
$X^{234}$ is a polar hydrophilic amino acid residue;
$X^{248}$ is an aliphatic amino acid residue;
$X^{250}$ is a basic amino acid residue;

$X^{263}$ is a acidic or polar amino acid residue;
$X^{290}$ is an acidic amino acid residue;
$X^{296}$ is an aliphatic amino acid residue
$X^{297}$ is an aromatic amino acid residue;
$X^{301}$ is an aliphatic or hydroxyl containing or acidic or hydrophilic or basic amino acid residue; and
$X^{307}$ is an aromatic, a polar or a hydroxyl containing amino acid residue. In one embodiment, the ketoreductase comprises all of the above characteristics. In one embodiment, the ketoreductase comprises at least one characteristic such that at least one residue is mutated as compared to SEQ ID NO:2. In one embodiment, the ketoreductase comprises at least one characteristic such that at least one residue is non-conservatively mutated as compared to SEQ ID NO:2.

In some embodiments, the ketoreductase comprises a ketoreductase having an improved activity as compared to a ketoreductase of SEQ ID NO:2, and that has an amino acid sequence that corresponds to the wild-type sequence ketoreductase of FIG. 3 (SEQ ID NO:2) and includes one or more mutations selected from: R27A, R27K, N31S, A36V, Y48H, I63W, R65G, R65S, L86I, F125L, K152R, A160T, Y194C, A218T, V248I, K250R, E290D, L296V, Y297W, Y297F, L301K, L301R, L301A, L301S, L301E, L301P, L301Q, L301V, L301T, L301Y, L301D, Y307H, Y307N, and Y307S. In some embodiments, such improved engineered ketoreductases comprise an amino acid sequence that is at least 90%, 91%, 92%, 93%, 94%, 95%, 96%, 97%, 98%, or 99% identical to SEQ ID NO:2, with the proviso that the amino acid sequence comprises at least one or more of the above listed mutations (in some embodiments, at least 2, 3, 4, 5, 6, 7, 8, 9, 10, 11, 12, 13, 14, 15, 16, 17, 18, 19, 20 or more of the mutations).

In some embodiments, the engineered ketoreductase comprises a ketoreductase with an improved enzyme stability having an amino acid sequence that corresponds to the wild-type sequence of FIG. 3 (SEQ ID NO:2) and includes one or more mutations selected from: E44D, I46L, I55V, I56V, A60T, I63V, L76M, G103S, L106I, D114G, L121I, Q144R, S148T, N158H, Q223H, I237G, I237N, I237R, S239T, and V253A.

In some embodiments, the engineered ketoreductase comprises a ketoreductase with a combination of improved enzyme activity and improved enzyme stability having a amino acid sequence that corresponds to the wild type sequence of FIG. 3 (SEQ ID NO:2) and that includes one or more mutations selected from: Q6E, N31P, A160S, Q165E, Q214H, Q214R, E234Q, Q263E. In one embodiment, the ketoreductase comprises all of these mutations.

In some embodiments, the engineered ketoreductase comprises a ketoreductase with a combination of improved enzyme activity and/or improved enzyme stability having an amino acid sequence that corresponds to the wild type sequence of FIG. 3 (SEQ ID NO:2) and includes one or more mutations selected from: N40Y, V43L, K51E, I58V, E62Q, A73P, K79R, K152Q, K169E, F185I, Q189H, G192D, H200L, D201G, K215E, K215M, K216R, D221V, S233C, I237D, K250E, I265V, L287R, K304R, Q310R, K311E, V312S, and V312E.

Specific exemplary embodiments of such engineered ketoreductases include SEQ ID NOS: 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, and 366.

In some embodiments, the engineered ketoreductase enzyme has an amino acid sequence that is at least about 80, 85, 90, 91, 92, 93, 94, 95, 96, 97, 98, or 99% identical to an amino acid sequence listed in Table 1.

In some embodiments, the ketoreductase comprises an amino acid sequence that is at least about 95, 96, 97, 98, or 99% identical to SEQ ID NO:316 or 318. In one embodiment, the ketoreductase comprises the amino acid sequence of SEQ ID NO:316 or 318, but with one or more conservative mutations (including 1, 2, 3, 4, 5, 6, 7, 8, 9, 10, or more) at residues that have not been mutated as compared to SEQ ID NO:2.

In another aspect, the present disclosure provides polynucleotides encoding the engineered ketoreductases described herein or polynucleotides that hybridize to such polynucleotides under highly stringent conditions. The polynucleotide can include promoters and other regulatory elements useful for expression of the encoded engineered ketoreductase, and can utilize codons optimized for specific desired expression systems.

In still another aspect, the present disclosure provides host cells comprising the polynucleotides and/or expression vectors described herein. The host cells may be Saccharomyces cerevisiae, which the engineered ketoreductase enzyme was derived from, or they may be a different organism. The host cells can be used for the expression and isolation of the engineered ketoreductase enzymes described herein, or, alternatively, they can be used in the various methods described further below.

The ketoreductase enzymes can be used to reduce hydroxy oxo ester enantiomers of structural formula (Ia) to their corresponding syn dihydroxys in high yield and with a high degree of stereo selectivity.

In one aspect, the ketoreductase enzymes are used in purified or isolated form. In another aspect, extracts from cells expressing the enzymes are used.

Thus, in another aspect, the present disclosure provides methods of producing a syn dihydroxy ester according to structural formula (IIa):

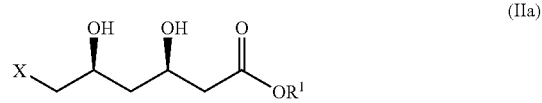

(IIa)

wherein X and $R^1$ are as previously defined. The methods generally comprise selectively reducing a hydroxy oxo ester enantiomer according to structural formula (Ia):

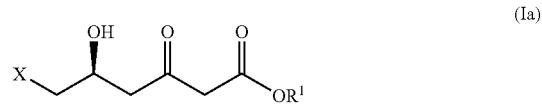

(Ia)

wherein X and $R^1$ are as defined for structural formula (IIa), using an engineered ketoreductase enzyme described herein. The method may be carried out using whole cells that express the engineered ketoreductase enzyme, such as the host cells described herein, extracts or lysates from such cells, or purified engineered ketoreductase enzymes.

As will be appreciated by skilled artisans, the reduction reaction illustrated above generally requires a cofactor, which is normally NADH or NADPH, and a system for regenerating the cofactor, for example glucose and glucose dehydrogenase. Since cells generally provide such cofactors and cofactor regeneration systems, in embodiments employing whole cells cell extracts or cell lysates, the addition of such cofactors and cofactor regeneration systems may be unnecessary. In embodiments employing purified engineered ketoreductase enzyme(s), such cofactors and optionally such cofactor regeneration systems will typically be added to the reaction medium along with the hydroxy oxo ester substrate and the ketoreductase enzyme(s). Like the engineered ketoreductase enzyme, any enzyme(s) comprising the cofactor regeneration system can be supplied to the reaction mixture in the form of extracts or lysates of such cells, or as purified enzyme(s). In embodiments employing cell extracts or cell lysates, the cells used to generate the extracts or lysates can be engineered to express the enzyme(s) comprising the cofactor regeneration systems alone, or together with the engineered ketoreductase enzyme. In embodiments employing whole cells, the cells can be engineered to express the enzyme(s) comprising the cofactor regeneration systems and the engineered ketoreductase enzyme together.

Whether carrying out the method with whole cells, cell extracts or purified ketoreductase enzymes, a single ketoreductase enzyme may be used or, alternatively, mixtures of two or more ketoreductase enzymes may be used.

The ketoreductase enzymes described herein are highly specific for the enantiomer of structural formula (Ia) and catalyze the above-described reduction reaction in high yield and with a high degree of stereoselectivity. Depending upon the particular engineered ketoreductase enzyme used, yields in the range of about 80 to 99.9% with a diastereomeric excess ("d.e.") of ≧99.5%, can be readily achieved. For example, it has been discovered that engineered ketoreductase enzymes of the present disclosure can be used to stereoselectively reduce the 5-hydroxyoxo ester enantiomer of structural formula (Ia), supra, to the corresponding syn dihydroxy of structural formula (IIa) with yields in the range of 90 to 99.9% and with a degree of stereoselectivity of ≧99.7%.

In many embodiments, diastereoselectivities of ≧99.8%, 99.9%, 99.91%, 99.92%, 99.93%, 99.94%, 99.5%, 99.96%, 99.97%, 99.98% and even 99.99% d.e. can be achieved. Indeed, as will be discussed in more detail below in connection with FIGS. 6 and 7, a crude, unpurified reduction product obtained from a starting substrate that was >99% pure in the enantiomer of structural formula (Ia) using the engineered ketoreductase enzyme of SEQ ID NO:316 was >99.99% pure in the syn diastereomer of structural formula (IIa).

Because the engineered ketoreductase enzymes described herein are so highly stereoselective, the resultant syn dihydroxy ester of structural formula (IIa) can be recovered in substantially stereochemically pure form without the need to chirally separate it from the corresponding anti or any other diastereomer. Indeed, owing to the high yield and high stereoselectivity of the reaction, if the hydroxy oxo ester substrate of structural formula (I) is substantially pure in the enantiomer of structural formula (Ia), the specific syn dihydroxy ester diastereomer of structural formula (IIa) can be recovered from the reaction medium as a substantially pure or pure diastereomer without purification.

The chiral dihydroxy ester of structural formula (IIa) can be used as a starting material to synthesize cholesterol-lowering statins, including but not limited to, atorvastatin, rosuvastatin, and pitavastatin. A key step in many of these methods is protecting the hydroxyl groups of the syn dihydroxy ester of structural formula (IIa), yielding a protected syn dihydroxy ester according to structural formula (IIIa):

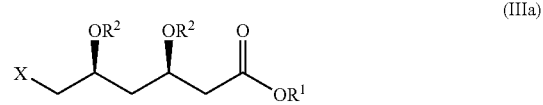

(IIIa)

wherein X and $R^1$ are as previously defined for structural formula (IIa) and each $R^2$ is a protecting group or, alternatively, the two $R^2$ groups can be taken together to form a substituted or unsubstituted alkylene bridge. In some embodiments, the protected syn dihydroxy ester is a compound according to structural formula (IVa):

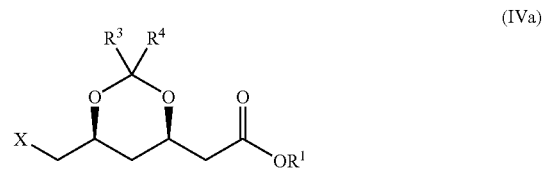

(IVa)

wherein X and $R^1$ are as previously defined for structural formula (IIa) and $R^3$ and $R^4$ are each, independently of one another, selected from hydrogen, (C1-C12) alkyl, (C6-C10) aryl and (C7-C12) arylalkyl, or alternatively, $R^3$ and $R^4$ taken together form a (C4-C10) cycloalkyl or heterocycloalkyl. In a specific embodiment, $R^3$ and $R^4$ are each methyl.

In some embodiments, the protected syn dihydroxy ester is a compound according to structural formula (Va):

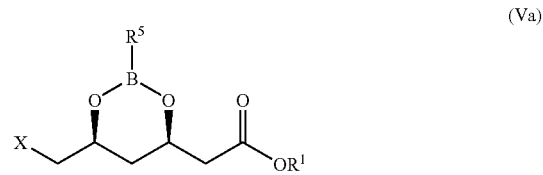

(Va)

wherein X and $R^1$ are as previously defined for structural formula (IIa), and $R^5$ is selected from (C1-C12) alkyl, (C6-C10) aryl and (C7-C12) arylalkyl. In some embodiments, $R^5$ is phenyl.

Owing to their stereoselectivity, the engineered ketoreductase enzymes described herein can be used to synthesize stereoisomerically pure preparations of protected syn dihydroxy esters according to structural formula (IIIa), (IVa) and (Va). The methods generally comprise enantioselectively reducing a hydroxyoxoester enantiomer according to structural formula (Ia), supra, using an engineered ketoreductase enzyme as described herein to yield a first reaction product comprising a syn dihydroxy ester according to structural formula (IIa), supra, and protecting the hydroxyl groups of the syn dihydroxy ester to yield the protected syn dihydroxy ester of structural formula (IIIa). Owing to the high stereoselectivity of the engineered ketoreductase enzymes, the protected syn dihydroxy ester of structural formula (IIIa) can be recovered as a substantially stereochemically pure or pure diastereomer, i.e., substantially free of the corresponding anti diastereomer and any other diastereomers, without chiral separation.

The syn dihydroxy esters and/or protected syn dihydroxy esters can be used as reactants in known methods to synthesize cholesterol lowering statins. Exemplary synthetic routes for preparing exemplary statins are illustrated in FIGS. 8, 9, and 10. Thus, in another aspect, the present disclosure provides methods of producing substantially stereoisomerically pure preparations of statins, such as, for example, atorvastatin, rosuvastatin, and pitavastatin. The methods generally comprises: (i) reducing a substantially enantiomerically pure hydroxy oxo ester enantiomer according to structural formula (Ia):

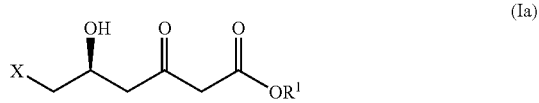

wherein $R^1$ and X are as previously defined, with an engineered ketoreductase enzyme described herein to yield a first reaction product comprising a substantially diastereomerically pure syn dihydroxy ester according to structural formula (IIa):

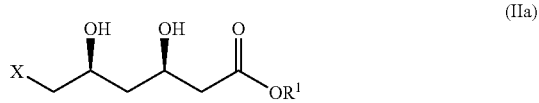

wherein X and $R^1$ are as defined for structural formula (Ia); and (ii) thereafter using the syn dihydroxy ester of structural formula (IIa) to synthesize a statin. Since the engineered ketoreductases described herein catalyze the reduction of step (i) with a high degree of enantioselectivity, the syn dihydroxy ester of structural formula (IIa) can be used to synthesize statins having a high degree of stereoisomeric purity using reactions carried out at nearly ambient temperature and without the need for chiral separations. Indeed, the high degree of stereoselectivity of the reduction reaction allows preparation of statins having a % d.e. that is within about 90 to 99.99% of the % e.e. of the hydroxy oxo ester starting substrate, readily and economically in high yield.

6. BRIEF DESCRIPTION OF THE FIGURES

FIG. 3 provides the wild-type sequence of the ketoreductase encoded by the Ydl124wp gene (Genbank Acc. No.: NP_010159.1; GI: 6320079) from *Saccharomyces cerevisiae* (SEQ ID NO:2).

FIG. 4 provides the amino acid sequence of the ketoreductase from *Saccharomyces cerevisiae* with the residues marked that can be modified to generate engineered polypeptides with improved ketoreductase properties.

Figure 5:
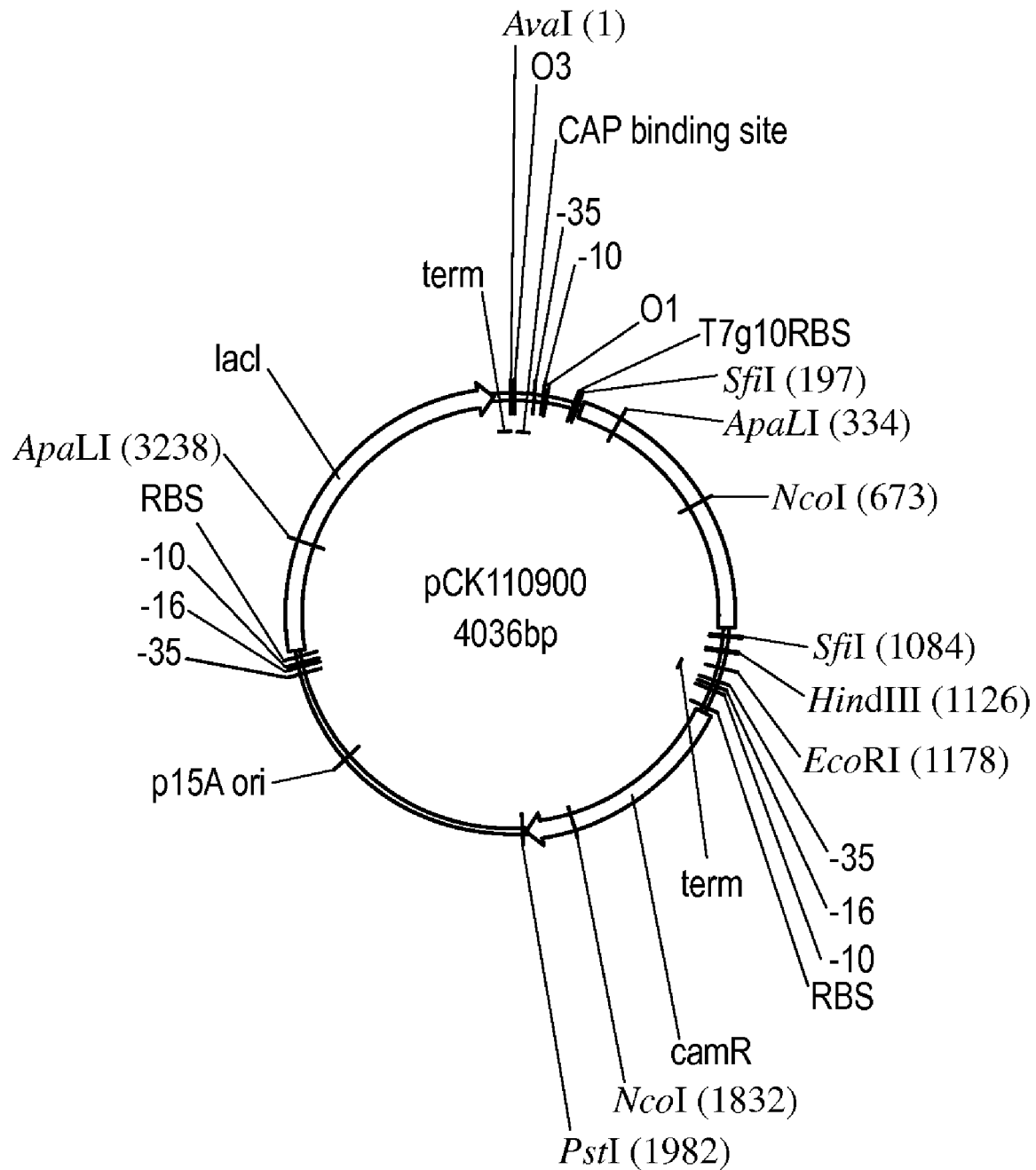

FIG. 5 provides an illustration of plasmid pCK110900 in which cloned ketoreductase genes are operatively linked to the lac promoter under control of the lacI repressor for expressing engineered ketoreductase enzymes.

Figure 6A:
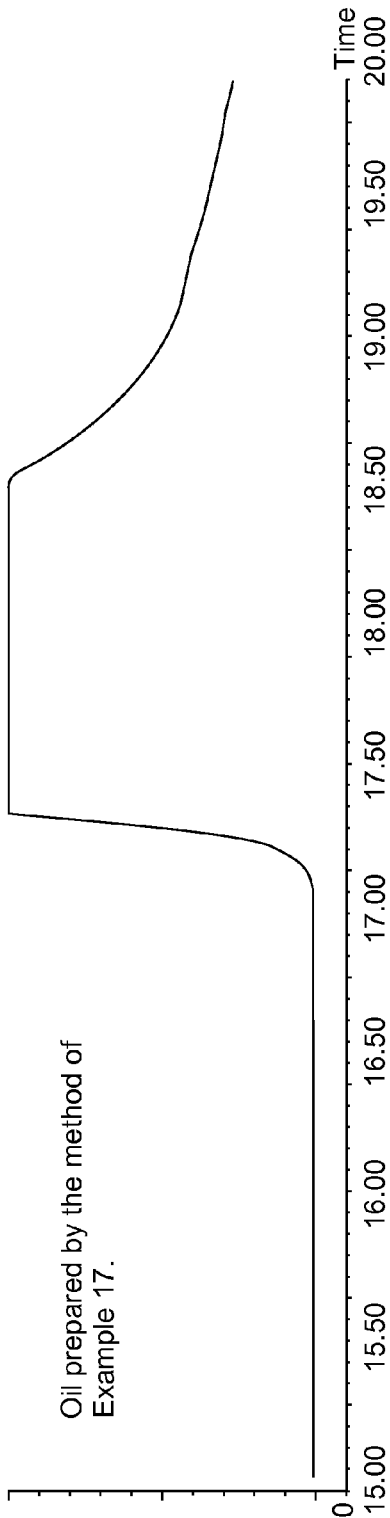
Figure 6B:
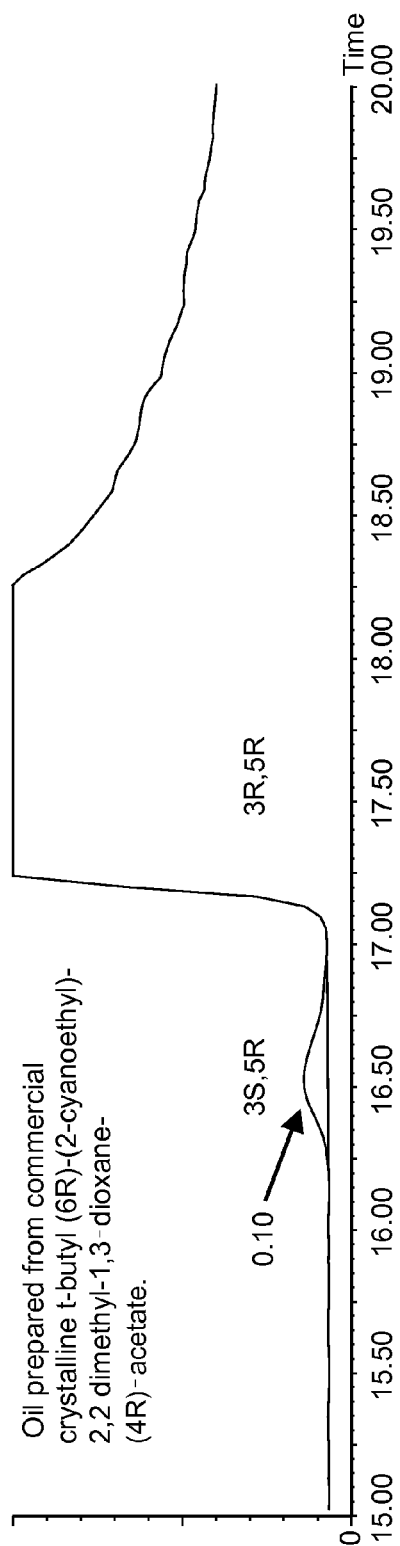

FIG. 6 shows LC/MS/MS chromatograms of t-butyl 6-cyano-(3R,5R)-dihydroxyhexanoate samples of Example 17 (a sample prepared by an embodiment of the methods described herein) (upper panel) and a sample prepared from commercial crystalline t-butyl (6R)-(2-cyanoethyl)-2,2 dimethyl-1,3-dioxane-(4R)-acetate (lower panel).

Figure 7:
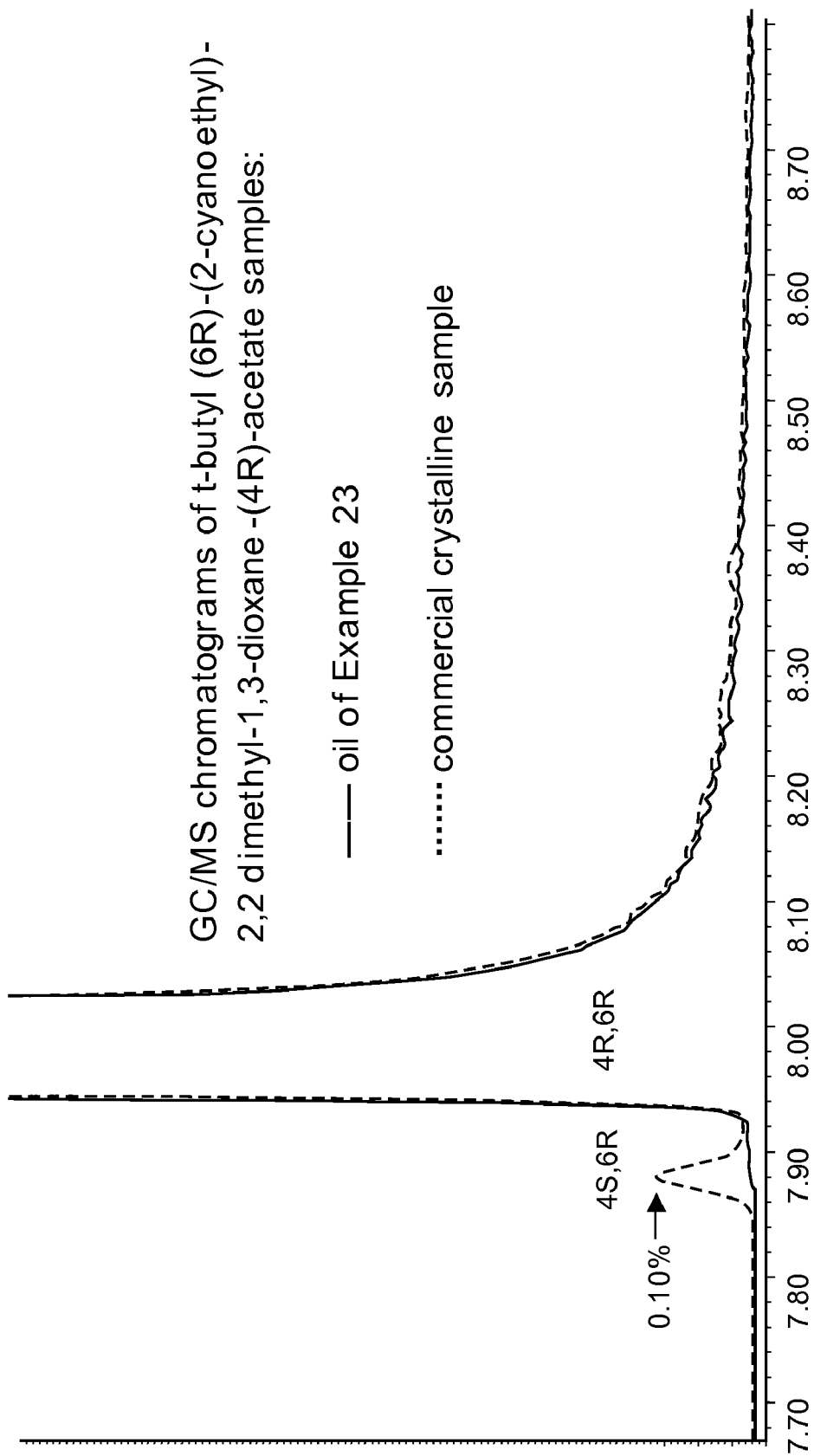

FIG. 7 shows GC/MS chromatograms of t-butyl (6R)-(2-cyanoethyl)-2,2 dimethyl-1,3 dioxane-(4R)-acetate samples of Example 23 (a sample prepared by the method of the invention) and a commercial crystalline sample.

Figure 8:
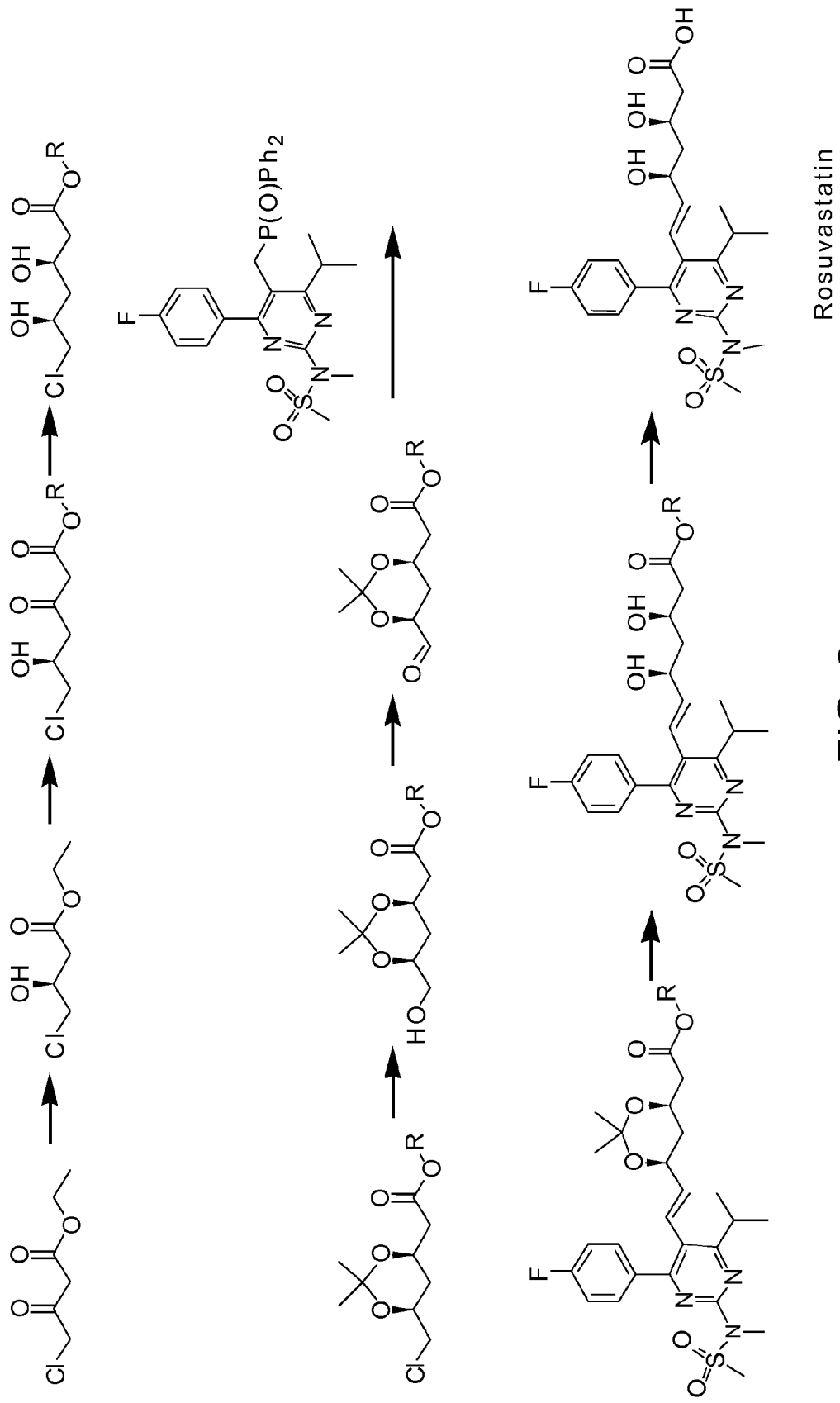

FIG. 8 illustrates a synthetic scheme for rosuvastatin; R represents H or a suitable protecting group.

Figure 9:
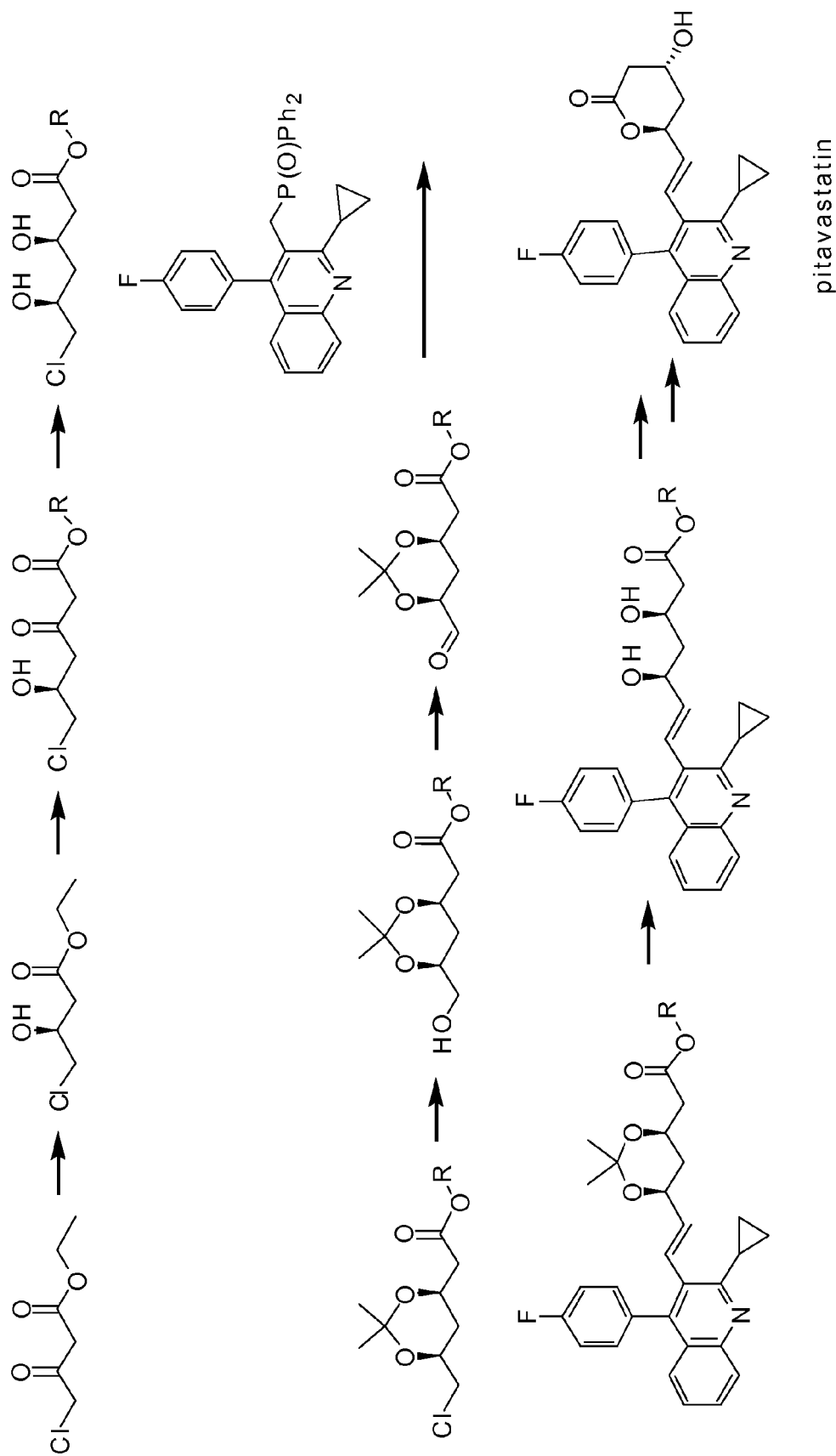

FIG. 9 illustrates a synthetic scheme for pitavastatin; R represents H or a suitable protecting group.

Figure 10:
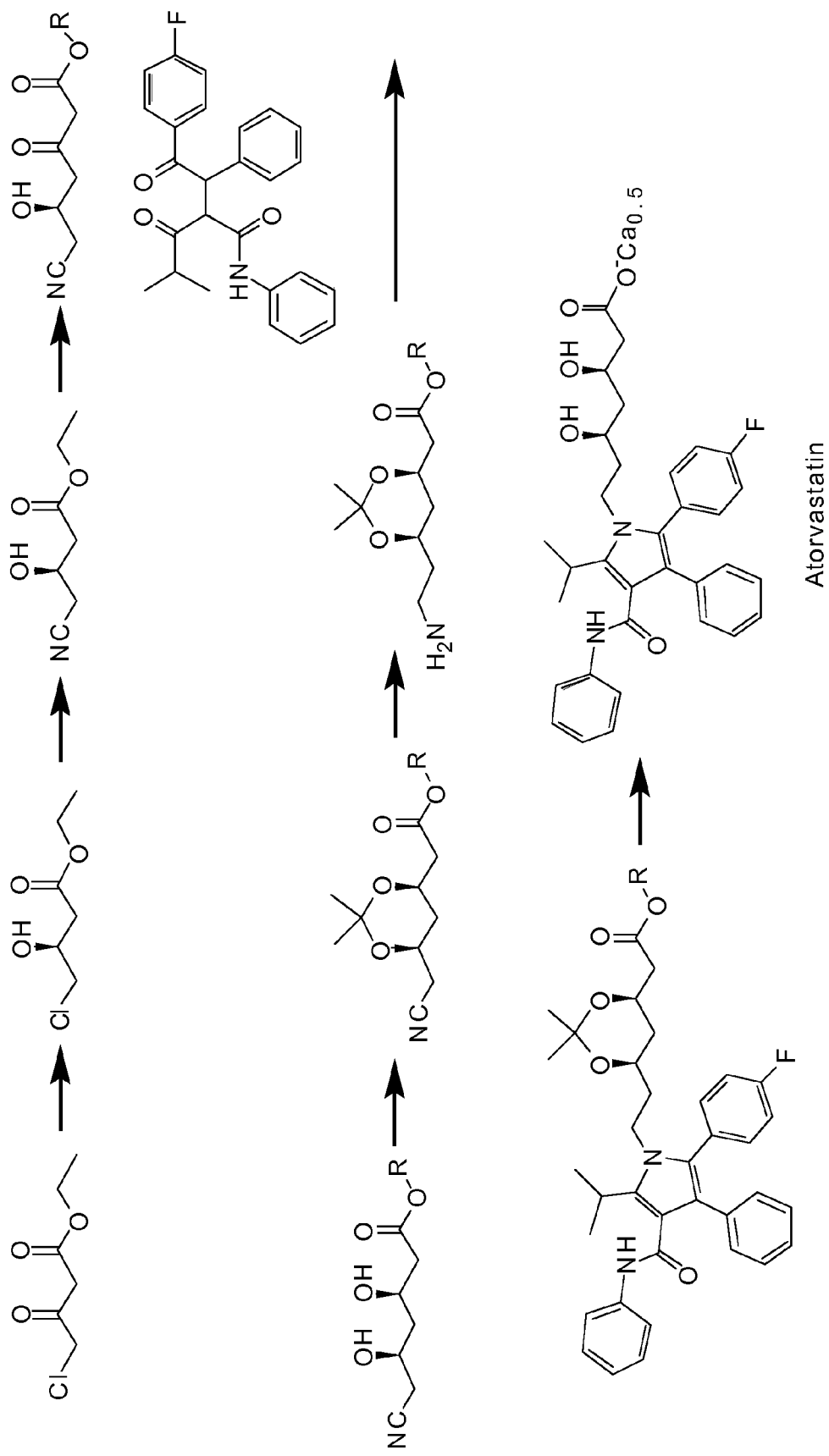

FIG. 10 illustrates a synthetic scheme for atorvastatin; R represents H or a suitable protecting group.

7. DETAILED DESCRIPTION

7.1 Definitions

As used herein, the following terms are intended to have the following meanings:

"Alkyl" by itself or as part of another substituent refers to a saturated or unsaturated branched, straight-chain or cyclic monovalent hydrocarbon radical having the stated number of carbon atoms (i.e., C1-C6 means one to six carbon atoms) that is derived by the removal of one hydrogen atom from a single carbon atom of a parent alkane, alkene or alkyne. Typical alkyl groups include, but are not limited to, methyl; ethyls such as ethanyl, ethenyl, ethynyl; propyls such as propan-1-yl, propan-2-yl, cyclopropan-1-yl, prop-1-en-1-yl, prop-1-en-2-yl, prop-2-en-1-yl, cycloprop-1-en-1-yl; cycloprop-2-en-1-yl, prop-1-yn-1-yl, prop-2-yn-1-yl, etc.; butyls such as butan-1-yl, butan-2-yl, 2-methyl-propan-1-yl, 2-methyl-propan-2-yl, cyclobutan-1-yl, but-1-en-1-yl, but-1-en-2-yl, 2-methyl-prop-1-en-1-yl, but-2-en-1-yl, but-2-en-2-yl, buta-1,3-dien-1-yl, buta-1,3-dien-2-yl, cyclobut-1-en-1-yl, cyclobut-1-en-3-yl, cyclobuta-1,3-dien-1-yl, but-1-yn-1-yl, but-1-yn-3-yl, but-3-yn-1-yl, etc.; and the like. Where specific levels of saturation are intended, the nomenclature "alkanyl," "alkenyl" and/or "alkynyl" is used, as defined below. "Lower alkyl" refers to an alkyl group containing from 1 to 6 carbon atoms.

"Alkanyl" by itself or as part of another substituent refers to a saturated branched, straight-chain or cyclic alkyl derived by the removal of one hydrogen atom from a single carbon atom of a parent alkane. Typical alkanyl groups include, but are not limited to, methanyl; ethanyl; propanyls such as propan-1-yl, propan-2-yl (isopropyl), cyclopropan-1-yl, etc.; butanyls such as butan-1-yl, butan-2-yl (sec-butyl), 2-methyl-propan-1-yl (isobutyl), 2-methyl-propan-2-yl (t-butyl), cyclobutan-1-yl, etc.; and the like.

"Alkenyl" by itself or as part of another substituent refers to an unsaturated branched, straight-chain or cyclic alkyl having at least one carbon-carbon double bond derived by the removal of one hydrogen atom from a single carbon atom of a parent alkene. The group may be in either the cis or trans conformation about the double bond(s). Typical alkenyl groups include, but are not limited to, ethenyl; propenyls such as prop-1-en-1-yl, prop-1-en-2-yl, prop-2-en-1-yl, prop-2-en-2-yl, cycloprop-1-en-1-yl; cycloprop-2-en-1-yl; butenyls such as but-1-en-1-yl, but-1-en-2-yl, 2-methyl-prop-1-en-1-yl, but-2-en-1-yl, but-2-en-2-yl, buta-1,3-dien-1-yl, buta-1,3- dien-2-yl, cyclobut-1-en-1-yl, cyclobut-1-en-3-yl, cyclobuta-1,3-dien-1-yl, etc.; and the like.

"Alkynyl" by itself or as part of another substituent refers to an unsaturated branched, straight-chain or cyclic alkyl having at least one carbon-carbon triple bond derived by the removal of one hydrogen atom from a single carbon atom of a parent alkyne. Typical alkynyl groups include, but are not limited to, ethynyl; propynyls such as prop-1-yn-1-yl, prop-2-yn-1-yl, etc.; butynyls such as but-1-yn-1-yl, but-1-yn-3-yl, but-3-yn-1-yl, etc.; and the like.

"Alkyldiyl" by itself or as part of another substituent refers to a saturated or unsaturated, branched, straight-chain or cyclic divalent hydrocarbon group having the stated number of carbon atoms (i.e., C1-C6 means from one to six carbon atoms) derived by the removal of one hydrogen atom from each of two different carbon atoms of a parent alkane, alkene or alkyne, or by the removal of two hydrogen atoms from a single carbon atom of a parent alkane, alkene or alkyne. The two monovalent radical centers or each valency of the divalent radical center can form bonds with the same or different atoms. Typical alkyldiyl groups include, but are not limited to, methandiyl; ethyldiyls such as ethan-1,1-diyl, ethan-1,2-diyl, ethen-1,1-diyl, ethen-1,2-diyl; propyldiyls such as propan-1,1-diyl, propan-1,2-diyl, propan-2,2-diyl, propan-1,3-diyl, cyclopropan-1,1-diyl, cyclopropan-1,2-diyl, prop-1-en-1,1-diyl, prop-1-en-1,2-diyl, prop-2-en-1,2-diyl, prop-1-en-1,3-diyl, cycloprop-1-en-1,2-diyl, cycloprop-2-en-1,2-diyl, cycloprop-2-en-1,1-diyl, prop-1-yn-1,3-diyl, etc.; butyldiyls such as, butan-1,1-diyl, butan-1,2-diyl, butan-1,3-diyl, butan-1,4-diyl, butan-2,2-diyl, 2-methyl-propan-1,1-diyl, 2-methyl-propan-1,2-diyl, cyclobutan-1,1-diyl; cyclobutan-1,2-diyl, cyclobutan-1,3-diyl, but-1-en-1,1-diyl, but-1-en-1,2-diyl, but-1-en-1,3-diyl, but-1-en-1,4-diyl, 2-methyl-prop-1-en-1,1-diyl, 2-methanylidene-propan-1,1-diyl, buta-1,3-dien-1,1-diyl, buta-1,3-dien-1,2-diyl, buta-1,3-dien-1,3-diyl, buta-1,3-dien-1,4-diyl, cyclobut-1-en-1,2-diyl, cyclobut-1-en-1,3-diyl, cyclobut-2-en-1,2-diyl, cyclobuta-1,3-dien-1,2-diyl, cyclobuta-1,3-dien-1,3-diyl, but-1-yn-1,3-diyl, but-1-yn-1,4-diyl, buta-1,3-diyn-1,4-diyl, etc.; and the like. Where specific levels of saturation are intended, the nomenclature alkanyldiyl, alkenyldiyl and/or alkynyldiyl is used. Where it is specifically intended that the two valencies be on the same carbon atom, the nomenclature "alkylidene" is used. A "lower alkyldiyl" is an alkyldiyl group containing 1 to 6 carbon atoms. In some embodiments the alkyldiyl groups are saturated acyclic alkanyldiyl groups in which the radical centers are at the terminal carbons, e.g., methandiyl (methano); ethan-1,2-diyl (ethano); propan-1,3-diyl (propano); butan-1,4-diyl (butano); and the like (also referred to as alkylenes, defined infra).

"Alkylene" by itself or as part of another substituent refers to a straight-chain saturated or unsaturated alkyldiyl group having two terminal monovalent radical centers derived by the removal of one hydrogen atom from each of the two terminal carbon atoms of straight-chain parent alkane, alkene or alkyne. The locant of a double bond or triple bond, if present, in a particular alkylene is indicated in square brackets. Typical alkylene groups include, but are not limited to, methylene (methano); ethylenes such as ethano, etheno, ethyno; propylenes such as propano, prop[1]eno, propa[1,2]dieno, prop[1]yno, etc.; butylenes such as butano, but[1]eno, but[2]eno, buta[1,3]dieno, but[1]yno, but[2]yno, buta[1,3]diyno, etc.; and the like. Where specific levels of saturation are intended, the nomenclature alkano, alkeno and/or alkyno is used. In some embodiments, the alkylene group is (C1-C6) or (C1-C3) alkylene. In some embodiments, the alkylene group is a straight-chain saturated alkano group, e.g., methano, ethano, propano, butano, and the like.

"Cycloalkyl" by itself or as part of another substituent refers to a cyclic version of an "alkyl" group. Typical cycloalkyl groups include, but are not limited to, cyclopropyl; cyclobutyls such as cyclobutanyl and cyclobutenyl; cyclopentyls such as cyclopentanyl and cyclopentenyl; cyclohexyls such as cyclohexanyl and cyclohexenyl; and the like.

"Parent Aromatic Ring System" refers to an unsaturated cyclic or polycyclic ring system having a conjugated π electron system. Specifically included within the definition of "parent aromatic ring system" are fused ring systems in which one or more of the rings are aromatic and one or more of the rings are saturated or unsaturated, such as, for example, fluorene, indane, indene, phenalene, tetrahydronaphthalene, etc. Typical parent aromatic ring systems include, but are not limited to, aceanthrylene, acenaphthylene, acephenanthrylene, anthracene, azulene, benzene, chrysene, coronene, fluoranthene, fluorene, hexacene, hexaphene, hexylene, indacene, s-indacene, indane, indene, naphthalene, octacene, octaphene, octalene, ovalene, penta-2,4-diene, pentacene, pentalene, pentaphene, perylene, phenalene, phenanthrene, picene, pleiadene, pyrene, pyranthrene, rubicene, tetrahydronaphthalene, triphenylene, trinaphthalene, and the like.

"Aryl" by itself or as part of another substituent refers to a monovalent aromatic hydrocarbon group having the stated number of carbon atoms (i.e., C5-C15 means from 5 to 15 carbon atoms) derived by the removal of one hydrogen atom from a single carbon atom of a parent aromatic ring system. Typical aryl groups include, but are not limited to, groups derived from aceanthrylene, acenaphthylene, acephenanthrylene, anthracene, azulene, benzene, chrysene, coronene, fluoranthene, fluorene, hexacene, hexaphene, hexylene, as-indacene, s-indacene, indane, indene, naphthalene, octacene, octaphene, octalene, ovalene, penta-2,4-diene, pentacene, pentalene, pentaphene, perylene, phenalene, phenanthrene, picene, pleiadene, pyrene, pyranthrene, rubicene, triphenylene, trinaphthalene, and the like, as well as the various hydro isomers thereof. In some embodiments, the aryl group is (C6-C10) Specific examples are phenyl and naphthyl.

"Arylalkyl" by itself or as part of another substituent refers to an acyclic alkyl group in which one of the hydrogen atoms bonded to a carbon atom, typically a terminal or $sp^3$ carbon atom, is replaced with an aryl group. Typical arylalkyl groups include, but are not limited to, benzyl, 2-phenylethan-1-yl, 2-phenylethen-1-yl, naphthylmethyl, 2-naphthylethan-1-yl, 2-naphthylethen-1-yl, naphthobenzyl, 2-naphthophenylethan-1-yl and the like. Where specifically saturated or unsaturated alkyl moieties are intended, the nomenclature arylalkanyl, arylalkenyl and/or arylalkynyl is used. In some embodiments, the arylalkyl group is (C7-C12) arylalkyl. In a specific embodiment the alkanyl, alkenyl or alkynyl moiety of the arylalkyl group is (C1-C2) and the aryl moiety is (C6-C10).

"Ketoreductase" and "KRED" are used interchangeably herein to refer to a polypeptide that is capable of enantioselectively reducing the 3-oxo group of a 5-hydroxy-3-oxohexanoate ester enantiomer to yield the corresponding syn 3,-5-dihydroxyhexanoate ester. The polypeptide typically utilizes the cofactor reduced nicotinamide adenine dinucleotide (NADH) or reduced nicotinamide adenine dinucleotide phosphate (NADPH) as the reducing agent. Ketoreductases as used herein include naturally occurring (wild type) ketoreductases as well as non-naturally occurring engineered polypeptides generated by human manipulation.

"Coding sequence" refers to that portion of a nucleic acid (e.g., a gene) that encodes an amino acid sequence of a protein.

"Naturally-occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

"Recombinant" when used with reference to, e.g., a cell, nucleic acid, or polypeptide, refers to a material, or a material corresponding to the natural or native form of the material, that has been modified in a manner that would not otherwise exist in nature, or is identical thereto but produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

"Percentage of sequence identity" and "percentage homology" are used interchangeably herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman, 1981, *Adv. Appl. Math.* 2:482, by the homology alignment algorithm of Needleman and Wunsch, 1970, *J. Mol. Biol.* 48:443, by the search for similarity method of Pearson and Lipman, 1988, *Proc. Natl. Acad. Sci. USA* 85:2444, by computerized implementations of these algorithms (GAP, BESTFIT, FASTA, and TFASTA in the GCG Wisconsin Software Package), or by visual inspection (see generally, *Current Protocols in Molecular Biology*, F. M. Ausubel et al., eds., Current Protocols, a joint venture between Greene Publishing Associates, Inc. and John Wiley & Sons, Inc., (1995 Supplement) (Ausubel)). Examples of algorithms that are suitable for determining percent sequence identity and sequence similarity are the BLAST and BLAST 2.0 algorithms, which are described in Altschul et al., 1990, *J. Mol. Biol.* 215: 403-410 and Altschul et al., 1977, *Nucleic Acids Res.* 3389-3402, respectively. Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff, 1989, *Proc Natl Acad Sci USA* 89:10915). Exemplary determination of sequence alignment and % sequence identity can employ the BESTFIT or GAP programs in the GCG Wisconsin Software package (Accelrys, Madison Wis.), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides over a "comparison window" to identify and compare local regions of sequence similarity.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Substantial identity" refers to a polynucleotide or polypeptide sequence that has at least 80 percent sequence identity, at least 85 percent identity and 89 to 95 percent sequence identity, more usually at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). Preferably, residue positions which are not identical differ by conservative amino acid substitutions.

"Stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly reported in the art (typically as a percentage) as the enantiomeric excess calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in the sum with others. In the context of the present disclosure, diastereoselectivity refers to the fraction (typically reported as a percentage) of the hydroxy oxo ester of structural formula (Ia) that gets converted into the syn dihydroxy ester of structural formula IIa, as opposed to the anti dihydroxy ester of formula IIb. It may also be reported (typically as a percentage) as the diastereomeric excess calculated therefrom according to the formula [syn IIa−anti IIb]/[syn IIa+anti IIb].

7.2 Ketoreductase Enzymes

The present disclosure provides engineered ketoreductase ("KRED") enzymes that are capable of enantioselectively reducing the 3-oxo group of a 5-hydroxy-3-oxohexanoate ester enantiomer to produce the corresponding syn 3,5-dihydroxyhexanoate ester, and have at least one improved property when compared with the naturally-occurring, wild-type KRED enzyme obtained from *Saccharomyces cerevisiae*. As noted above, the stereoisomerically pure syn 3,5-dihydroxyhexanoate esters produced by the ketoreductase can serve as intermediates for the synthesis of several cholesterol lowering statins. Improvements in various enzyme properties can facilitate use of these engineered ketoreductases in large scale production of this intermediate compound. Any number of improvements in enzymatic properties would be useful for the described application, for example, enzymatic activity, thermal stability, and reduced cofactor requirement.

Ketoreductase enzymes having improved properties can be obtained by mutating the genetic material encoding the ketoreductase enzyme of *Saccharomyces cerevisiae* and identifying polynucleotides that express engineered enzymes with a desired property. These non-naturally occurring ketoreductases can be generated by various well-known techniques, such as in vitro mutagenesis or directed evolution. In some embodiments, directed evolution is an attractive method for generating engineered enzymes because of the relative ease of generating mutations throughout the whole of the gene coding for the polypeptide, as well as providing the ability to take previously mutated polynucleotides and subjecting them to additional cycles of mutagenesis and/or recombination to obtain further improvements in a selected enzyme property. Subjecting the whole gene to mutagenesis can reduce the bias that may result from restricting the changes to a limited region of the gene. It can also enhance generation of enzymes affected in different enzyme properties since distantly spaced parts of the enzyme may play a role in various aspects of enzyme function. Mutagenesis and directed evolution techniques useful for the purposes herein are amply described in the literature: Ling, et al., 1997, "Approaches to DNA mutagenesis: an overview," *Anal. Biochem.* 254(2):157-78; Dale et al., 1996, "Oligonucleotide-directed random mutagenesis using the phosphorothioate method," *Methods Mol. Biol.* 57:369-74; Smith, 1985, "In vitro mutagenesis," *Ann. Rev. Genet.* 19:423-462; Botstein et al., 1985, "Strategies and applications of in vitro mutagenesis," *Science* 229:1193-1201; Carter, 1986, "Site-directed mutagenesis," *Biochem. J.* 237:1-7; Kramer et al., 1984, "Point Mismatch Repair," *Cell,* 38:879-887; Wells et al., 1985, "Cassette mutagenesis: an efficient method for generation of multiple mutations at defined sites," *Gene* 34:315-323; Minshull et al., 1999, "Protein evolution by molecular breeding," *Curr Opin Chem Biol* 3:284-290; Christians et al., 1999, "Directed evolution of thymidine kinase for AZT phosphorylation using DNA family shuffling," *Nature Biotech* 17:259-264; Crameri et al., 1998, "DNA shuffling of a family of genes from diverse species accelerates directed evolution," *Nature* 391:288-291; Crameri et al., 1997, "Molecular evolution of an arsenate detoxification pathway by DNA shuffling," *Nature Biotech* 15:436-438; Zhang et al., 1997, "Directed evolution of an effective fructosidase from a galactosidase by DNA shuffling and screening," *Proc Natl Acad Sci USA* 94:45-4-4509; Crameri et al., 1996, "Improved green fluorescent protein by molecular evolution using DNA shuffling,' *Nature Biotech* 14:315-319; Stemmer, 1994, "Rapid evolution of a protein in vitro by DNA shuffling," *Nature* 370:389-391; Stemmer, 1994, "DNA shuffling by random fragmentation and reassembly: In vitro recombination for molecular evolution," *Proc Natl Acad Sci USA* 91:10747-10751; WO 95/22625; WO 97/0078; WO 97/35966; WO 98/27230; WO 00/42651; WO 01/75767 and U.S. Pat. No. 6,537,746. All publications are incorporated herein by reference.

The naturally occurring polynucleotide encoding the naturally occurring ketoreductase of *Saccharomyces cerevisiae* can be obtained from the isolated polynucleotide known to encode the ketoreductase activity (Genbank accession no. NP_010159 GI: 6320079). Alternatively, a polynucleotide encoding the naturally occurring ketoreductases can be synthesized by polynucleotide synthesis methodologies known in the art based on the reported polynucleotide sequence of the *Saccharomyces cerevisiae* ketoreductase-encoding gene. In various embodiments, as further described below, the naturally occurring polynucleotide encoding the ketoreductase can be codon optimized to the codons preferred by a specific host cell used for expression of the enzyme. See e.g., Example 1.

The parent or reference polynucleotide encoding the naturally occurring or wild type ketoreductase is subjected to mutagenic processes, for example random mutagenesis and recombination, to introduce mutations into the polynucleotide. The mutated polynucleotide is expressed and translated, thereby generating engineered ketoreductase enzymes with modifications to the polypeptide. As used herein, "modifications" include amino acid substitutions, deletions, and insertions. Any one or a combination of modifications can be introduced into the naturally occurring enzymatically active polypeptide to generate engineered enzymes, which are then screened by various methods to identify polypeptides, and corresponding polynucleotides, having a desired improvement in a specific enzyme property. A polynucleotide encoding an engineered ketoreductase with an improved property can be subjected to additional rounds of mutagenesis treatments to generate polypeptides with further improvements in the desired enzyme property.

As used herein, a ketoreductase enzyme that has an "improved enzyme property" refers to a ketoreductase enzyme that exhibits an improvement in any enzyme property as compared to a reference ketoreductase enzyme. For the engineered ketoreductase enzymes described herein, the comparison is generally made to the wild-type *Saccharomyces cerevisiae* ketoreductase enzyme (SEQ ID NO:2), although in some embodiments, the reference ketoreductase can be another improved engineered ketoreductase. Enzyme properties for which improvement is desirable include, but are not limited to, enzymatic activity, thermal stability, pH activity profile, cofactor requirements, refractoriness to inhibitors (e.g., product inhibition), sterospecificity, and stereoselectivity.

As used herein the context of engineered ketoreductase enzymes, "derived from" identifies the originating ketoreductase enzyme, and/or the gene encoding such ketoreductase enzyme, upon which the engineering was based. For example, the engineered ketoreductase enzyme of SEQ ID NO:80 was obtained by artificially evolving, over multiple generations the gene encoding the *Saccharomyces cerevisiae* ketoreductase enzyme of SEQ ID NO:2. Thus, this engineered ketoreductase enzyme is "derived from" the wild-type ketoreductase of SEQ ID NO.: 2.

While not intending to be bound by any theory of operation, it is believed that the improvements in enzyme properties arise from introduction of modifications into a polypeptide chain that, in effect, perturb the structure-function of the enzyme and/or its interactions with another molecule (e.g., substrate). Some regions of the polypeptide may be critical to enzyme activity, for example amino acids involved in catalysis and substrate binding domains, such that small perturbations to these regions may have significant effects on enzyme function. Some amino acid residues may be at important positions for maintaining the secondary or tertiary structure of the enzyme, and thus also produce noticeable changes in enzyme properties when modified. On the other hand, some regions of the polypeptide may have a global structural role or form part of the enzyme less involved in the critical aspects of enzyme function (e.g., a peptide loop connecting alpha helices) and produce a measurable effect on enzyme function only when a large number of substitutions have accumulated in the region. Thus, in some embodiments, the number of modifications to the naturally occurring polypeptide that produces an improved ketoreductase property may comprise one or more amino acids, 2 or more amino acids, 5 or more amino acids, 10 or more amino acids, or 20 or more amino acids, up to 10% of the total number of amino acids, up to 20% of the total number of amino acids, or up to 30% of the total number of amino acids of the reference enzyme sequence.

Because of the nature of the technique, gene evolution approaches, such as DNA mutagenesis and recombination, biases the modification towards amino acid substitutions. Thus, in various embodiments, the improvements in enzyme properties can arise from substitutions at one amino acid residue, 2 or more amino acid residues, 5 or more amino acid residues, 10 or more amino acid residue, 15 or more amino acid residues, 20 or more amino acid residues, up to 10% of the total number of amino acids, up to 20% of the total number of amino acids, or up to 30% of the total number of amino acids making up the reference enzyme sequence.

As will be apparent to the skilled artisan, an analysis of amino acid substitutions for a large number of engineered ketoreductase with an improved enzyme property shows that the substitutions recur at certain amino acid residues in the ketoreductase polypeptide as well as a bias towards certain types of amino acids. This recurrence of substitutions at certain defined positions within the polypeptide may reflect the effect of amino acid residue on that particular enzyme property and its retention by the continued imposition of selection for the particular improved enzyme property. The recurrence of substitutions as well as the bias of the types of substituted amino acids can be grouped to describe the types of substitutions allowable for generating the improved enzyme property. Typically, genetically encoded amino acids can be grouped into the following classes based on their side chain properties:

"Hydrophilic Amino Acid or Residue" refers to an amino acid or residue having a side chain exhibiting a hydrophobicity of less than zero according to the normalized consensus hydrophobicity scale of Eisenberg et al., 1984, *J. Mol. Biol.* 179:125-142. Genetically encoded hydrophilic amino acids include L-Thr (T), L-Ser (S), L-His (H), L-Glu (E), L-Asn (N), L-Gln (Q), L-Asp (D), L-Lys (K) and L-Arg (R).

"Acidic Amino Acid or Residue" refers to a hydrophilic amino acid or residue having a side chain exhibiting a pK value of less than about 6 when the amino acid is included in a peptide or polypeptide. Acidic amino acids typically have negatively charged side chains at physiological pH due to loss of a hydrogen ion. Genetically encoded acidic amino acids include L-Glu (E) and L-Asp (D).

"Basic Amino Acid or Residue" refers to a hydrophilic amino acid or residue having a side chain exhibiting a pK value of greater than about 6 when the amino acid is included in a peptide or polypeptide. Basic amino acids typically have positively charged side chains at physiological pH due to association with hydronium ion. Genetically encoded basic amino acids include L-His (H), L-Arg (R) and L-Lys (K).

"Polar Amino Acid or Residue" refers to a hydrophilic amino acid or residue having a side chain that is uncharged at physiological pH, but which has at least one bond in which the pair of electrons shared in common by two atoms is held more closely by one of the atoms. Genetically encoded polar amino acids include L-Asn (N), L-Gln (Q), L-Ser (S) and L-Thr (T).

"Hydrophobic Amino Acid or Residue" refers to an amino acid or residue having a side chain exhibiting a hydrophobicity of greater than zero according to the normalized consensus hydrophobicity scale of Eisenberg et al., 1984, *J. Mol. Biol.* 179:125-142. Genetically encoded hydrophobic amino acids include L-Pro (P), L-Ile (I), L-Phe (F), L-Val (V), L-Leu (L), L-Trp (W), L-Met (M), L-Ala (A) and L-Tyr (Y).

"Aromatic Amino Acid or Residue" refers to a hydrophilic or hydrophobic amino acid or residue having a side chain that includes at least one aromatic or heteroaromatic ring. Genetically encoded aromatic amino acids include L-Phe (F), L-Tyr (Y) and L-Trp (W). Although owing to the pKa of its heteroaromatic nitrogen atom L-His (H) is classified above as a basic residue, as its side chain includes a heteroaromatic ring, it may also be classified as an aromatic residue.

"Non-polar Amino Acid or Residue" refers to a hydrophobic amino acid or residue having a side chain that is uncharged at physiological pH and which has bonds in which the pair of electrons shared in common by two atoms is generally held equally by each of the two atoms (i.e., the side chain is not polar). Genetically encoded non-polar amino acids include L-Leu (L), L-Val (V), L-Ile (I), L-Met (M) and L-Ala (A).

"Aliphatic Amino Acid or Residue" refers to a hydrophobic amino acid or residue having an aliphatic hydrocarbon side chain. Genetically encoded aliphatic amino acids include L-Ala (A), L-Val (V), L-Leu (L) and L-Ile (I).

The amino acid L-Cys (C) is unusual in that it can form disulfide bridges with other L-Cys (C) amino acids or other sulfanyl- or sulfhydryl-containing amino acids. The "cysteine-like residues" include cysteine and other amino acids that contain sulfhydryl moieties that are available for formation of disulfide bridges. The ability of L-Cys (C) (and other amino acids with —SH containing side chains) to exist in a peptide in either the reduced free —SH or oxidized disulfide-bridged form affects whether L-Cys (C) contributes net hydrophobic or hydrophilic character to a peptide. While L-Cys (C) exhibits a hydrophobicity of 0.29 according to the normalized consensus scale of Eisenberg (Eisenberg et al., 1984, supra), it is to be understood that for purposes of the present disclosure L-Cys (C) is categorized as a polar hydrophilic amino acid, notwithstanding the general classifications defined above.

The amino acid Gly (G) is also unusual in that it bears no side chain on its α-carbon and, as a consequence, contributes only a peptide bond to a particular peptide sequence. Moreover, owing to the lack of a side chain, it is the only genetically-encoded amino acid having an achiral α-carbon. Although Gly (G) exhibits a hydrophobicity of 0.48 according to the normalized consensus scale of Eisenberg (Eisenberg et al., 1984, supra), for purposes of the present invention, Gly is categorized as an aliphatic amino acid or residue.

"Small Amino Acid or Residue" refers to an amino acid or residue having a side chain that is composed of a total three or fewer carbon and/or heteroatoms (excluding the α-carbon and hydrogens). The small amino acids or residues may be further categorized as aliphatic, non-polar, polar or acidic small amino acids or residues, in accordance with the above definitions. Genetically-encoded small amino acids include Gly, L-Ala (A), L-Val (V), L-Cys (C), L-Asn (N), L-Ser (S), L-Thr (T) and L-Asp (D).

"Hydroxyl-containing Amino Acid or Residue" refers to an amino acid containing a hydroxyl (—OH) moiety. Genetically-encoded hydroxyl-containing amino acids include L-Ser (S) L-Thr (T) and L-Tyr (Y).

As will be appreciated by those of skill in the art, the above-defined categories are not mutually exclusive. Indeed, the delineated category of small amino acids includes amino acids from all of the other delineated categories except the aromatic category. Thus, amino acids having side chains exhibiting two or more physico-chemical properties can be included in multiple categories. As a specific example, amino acid side chains having heteroaromatic moieties that include ionizable heteroatoms, such as His, may exhibit both aromatic properties and basic properties, and can therefore be included in both the aromatic and basic categories. The appropriate classification of any amino acid or residue will be apparent to those of skill in the art, especially in light of the detailed disclosure provided herein.

In some embodiments, the substitution in the engineered ketoreductase may be a conservative substitution. The term "conservative amino acid substitutions" refer to the interchangeability of residues having similar side chains, and thus typically involves substitution of the amino acid in the polypeptide with amino acids within the same or similar defined class of amino acids. By way of example and not limitation, an amino acid with an aliphatic side chain may be substituted with another aliphatic amino acid, e.g., alanine, valine, leucine, isoleucine, and methionine; an amino acid with hydroxyl side chain is substituted with another amino acid with a hydroxyl side chain, e.g., serine and threonine; an amino acids having aromatic side chains is substituted with another amino acid having an aromatic side chain, e.g., phenylalanine, tyrosine, tryptophan, and histidine; an amino acid with a basic side chain is substituted with another amino acid with a basis side chain, e.g., lysine, arginine, and histidine; an amino acid with an acidic side chain is substituted with another amino acid with an acidic side chain, e.g., aspartic acid or glutamic acid; and a hydrophobic or hydrophilic amino acid is replaced with another hydrophobic or hydrophilic amino acid, respectively.

In some embodiments, the substitution in the engineered ketoreductase may be a conservative substitution. The term "conservative amino acid substitutions" refer to the interchangeability of residues having similar side chains, and thus typically involves substitution of the amino acid in the polypeptide with amino acids within the same or similar defined class of amino acids. By way of example and not limitation, an amino acid with an aliphatic side chain may be substituted with another aliphatic amino acid, e.g., alanine, valine, leucine, isoleucine, and methionine; an amino acid with hydroxyl side chain is substituted with another amino acid with a hydroxyl side chain, e.g., serine and threonine; an amino acids having aromatic side chains is substituted with another amino acid having an aromatic side chain, e.g., phenylalanine, tyrosine, tryptophan, and histidine; an amino acid with a basic side chain is substituted with another amino acid with a basis side chain, e.g., lysine, arginine, and histidine; an amino acid with an acidic side chain is substituted with another amino acid with an acidic side chain, e.g., aspartic acid or glutamic acid; and a hydrophobic or hydrophilic amino acid is replaced with another hydrophobic or hydrophilic amino acid, respectively.

In various embodiments, the substitutions for generating an improved ketoreductase can comprise conservative substitutions, non-conservative substitutions, as well as combinations of conservative and non-conservative substitutions.

In some embodiments, the improved engineered ketoreductase enzymes comprise deletions of the naturally occurring ketoreductase polypeptides as well as deletions of other improved ketoreductase polypeptides. The term "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered ketoreductase enzyme. Deletions can be directed to the internal portions and/or terminal portions of the polypeptide. In various embodiments, the deletion can comprise a continuous segment or can be discontinuous.

In other embodiments, the improved engineered ketoreductase enzymes comprise insertions of one or more amino acids to the naturally occurring ketoreductase polypeptide as well as insertions of one or more amino acids to other improved ketoreductase polypeptides. Insertions can be in the internal portions of the polypeptide, or to the carboxy or amino terminus Insertions as used herein include fusion proteins as is known in the art. The insertion can be a contiguous segment of amino acids or separated by one or more of the amino acids in the naturally occurring polypeptide.

As described above the various modifications introduced into the naturally occurring polypeptide to generate an engineered ketoreductase enzyme can be targeted to a specific property of the enzyme. Thus, in some embodiments, the improved property of the engineered ketoreductase polypeptides is an increased enzymatic activity, typically represented by an increase in specific activity (e.g., product produced/time/weight protein) as compared to the reference ketoreductase enzyme (i.e., the naturally occurring ketoreductase). Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.5 times the enzymatic activity of the corresponding wild-type ketoreductase enzyme, to as much as 2 times. 5 times, 10 times, 20 times, 25 times, 50 times, 75 times, 100 times, 150 times, 200 times, 250 times, 300 times, or more enzymatic activity than the naturally occurring ketoreductase of SEQ ID NO:2. In specific embodiments, the engineered ketoreductase enzyme exhibits improved enzymatic activity in the range of 1.5 to 50 times, 1.5 to 100 times, 1.5 to 150 times, 1.5 to 200 times, 1.5 to 250 times, or 1.5 to 300 times greater than that of the wild-type ketoreductase enzyme. It is understood by the skilled artisan that the activity of any enzyme is diffusion limited such that the catalytic turnover rate cannot exceed the diffusion rate of the substrate, including any required cofactors. The theoretical maximum of the diffusion limit, or $k_{cat}/K_m$, is generally about $10^8$ to $10^9$ ($M^{-1}$ $s^{-1}$). Hence, any improvements in the enzyme activity of the ketoreductase will have an upper limit related to the diffusion rate of the substrates acted on by the ketoreductase enzyme. Ketoreductase activity can be measured by any one of standard assays used for measuring ketoreductase, such as a decrease in absorbance or fluorescence of NADPH due to its oxidation with the concomitant reduction of a ketone to the corresponding alcohol, or by product produced in a coupled assay. Comparisons of enzyme activities are made using a defined preparation of enzyme and a defined assay under a set condition, as further described in detail herein. Generally, when lysates are compared, the numbers of cells and the amount of protein assayed are determined as well as use of identical expression systems and identical host cells to minimize variations in amount of enzyme produced by the host cells and present in the lysates.

In some embodiments, the engineered ketoreductase with improved enzyme activity comprise engineered polypeptides derived from *Saccharomyces cerevisiae* ketoreductase of SEQ ID NO:2. In some embodiments, the engineered ketoreductase comprises an amino acid sequence that is at least about 90, 91, 92, 93, 94, 95, 96, 97, 98, or 99% identical to SEQ ID NO:2. Amino acid residues that can be modified to generate engineered polypeptides with improved enzyme activity are shown in FIG. 4 in which X″ represents the modified amino acid residue. In some embodiments, one or more of the naturally occurring amino acid residue of SEQ ID NO:2 can be substituted as follows:

$X^6$ is a polar or acidic amino acid residue;
$X^{27}$ is an aliphatic or basic amino acid residue;
$X^{31}$ is a hydroxyl containing or aliphatic amino acid residue;
$X^{36}$ is a small amino acid residue;
$X^{48}$ is a basic amino acid residue;
$X^{63}$ is a hydrophobic or aromatic amino acid;
$X^{65}$ is a hydroxyl containing or small amino acid residue;
$X^{86}$ is an aliphatic or hydrophobic amino acid residue;
$X^{125}$ is an aliphatic or aromatic amino acid residue;
$X^{152}$ is a basic amino acid residue;
$X^{160}$ is a hydroxyl containing or small amino acid residue;
$X^{165}$ is a polar or acidic amino acid residue;
$X^{194}$ is an aromatic amino acid or polar hydrophilic amino acid residue
$X^{214}$ is a polar hydrophilic amino acid residue;
$X^{218}$ is a hydroxyl containing amino acid residue;
$X^{234}$ is a polar hydrophilic amino acid residue;
$X^{248}$ is an aliphatic amino acid residue;
$X^{250}$ is a basic amino acid residue;
$X^{263}$ is a acidic or polar amino acid residue;
$X^{290}$ is an acidic amino acid residue;
$X^{296}$ is an aliphatic amino acid residue
$X^{297}$ is an aromatic amino acid residue;
$X^{301}$ is an aliphatic, hydroxyl containing, acidic, hydrophilic, or basic amino acid residue; and/or
$X^{307}$ is an aromatic, a polar or a hydroxyl containing amino acid residue. In some embodiments, the ketoreductase has all of these residue characteristics.

In some embodiments, the ketoreductase has one or more of these residue characteristics. In some embodiments, at least one of these residue positions does not include a substitution that is a conservative mutation with respect to SEQ ID NO:2. In some embodiments, $X^{63}$ is an aromatic residue. In some embodiments, $X^{63}$ is tryptophan. In some embodiments, residues at other positions can be conservatively mutated with respect to SEQ ID NO:2.

In some embodiments, the amino acid residues of the ketoreductase of SEQ ID NO:2 can be substituted with one or more specific amino acids as follows:

$X^6$ is E;
$X^{27}$ is A or K;
$X^{31}$ is S or P;
$X^{36}$ is V;
$X^{48}$ is H;
$X^{63}$ is W;
$X^{65}$ is G or S;
$X^{86}$ is I;
$X^{125}$ is L;
$X^{152}$ is R;
$X^{160}$ is T or S;
$X^{165}$ is E;
$X^{194}$ is C;
$X^{214}$ is R or H;
$X^{218}$ is T;
$X^{234}$ is Q;
$X^{248}$ is I;
$X^{250}$ is R;
$X^{263}$ is E;
$X^{290}$ is V or D;
$X^{296}$ is I;
$X^{297}$ is F or W;
$X^{301}$ is R, K, A, V, S, T, Y, D, E, P, or Q; and/or
$X^{307}$ is H, N or S.

In some embodiments, the engineered ketoreductases with improved enzyme activity have substitutions in a subset of the amino acid residues indicated above. Thus, in some embodiments the amino acid substitutions can occur in one or more of the amino acid positions: $X^{27}$, $X^{31}$, $X^{36}$, $X^{48}$, $X^{63}$, $X^{65}$, $X^{86}$, $X^{125}$, $X^{152}$, $X^{160}$, $X^{194}$, $X^{218}$, $X^{248}$, $X^{250}$, $X^{290}$, $X^{296}$, $X^{297}$, $X^{301}$, and $X^{307}$, wherein the amino acid residues for substitution are selected as indicated above.

In some embodiments, the engineered ketoreductase comprises one or more mutations selected from: R27A, R27K, N31S, A36V, Y48H, I63W, R65G, R65S, L86I, F125L, K152R, A160T, Y194C, A218T, V248I, K250R, E290D, L296V, Y297W, Y297F, L301K, L301R, L301A, L301S, L301E, L301P, L301Q, L301V, L301T, L301Y, L301D, Y307H, Y307N, and Y307S.

It is also shown herein that the various amino acid residue positions whose substitutions result in a ketoreductase with improved properties are found to cluster in certain segments of the ketoreductase enzyme, which allows targeted modifications of the segments. Accordingly, in some embodiments, selected segments of the ketoreductase polypeptide may be subject to modification. For the reference sequence of SEQ ID NO:2, the segments affecting ketoreductase enzymatic activity include, among others, those represented by amino acid residues 27 to 36, 40 to 65, 103 to 125, 144 to 169, 233 to 265, and/or 287 to 312. One or more of the amino acid residues within each segment or combination of segments may be modified. In some embodiments, the corresponding amino acid sequences and positions for substitutions comprise:

$X^{27}WYKX^{31}EETDX^{36}$ $X^{40}SLX^{43}X^{44}QX^{46}VX^{48}ALX^{51}LPGX^{55}X^{56}HX^{58}DX^{60}AX^{62}X^{63}YX^{65}$ $X^{103}LDX^{106}ALKK\ MGTX^{114}YVDLYLX^{121}HSPX^{125}$ $X^{144}LYKX^{148}GKAX^{152}NIGVSX^{158}F$ $X^{160}VEDLX^{165}RILX^{169}$ $X^{233}X^{234}KYX^{237}KX^{239}EAQIILRWX^{248}TX^{250}RGX^{253}LPVTTSS\ KPX^{263}RX^{265}$; and $X^{290}HEPLRX^{296}X^{297}WNKX^{301}YGKYNX^{307}AAX^{310}X^{311}X^{312}$ wherein $X^n$ indicates positions of the amino acid substitutions.

In some embodiments, the engineered ketoreductase enzyme with improved enzymatic activity has an amino acid sequence selected from the amino acid sequences recited in Table 1:

TABLE 1

| Nucleic Acid SEQ ID NO. | Protein SEQ ID NO. | Residue substitutions | Activity | temperature for stability test (° C.) | Stability |
|---|---|---|---|---|---|
| 15 | 16 | L106I; | * | 37 | + |
| 17 | 18 | G112R; A160T; | * | 37 | + |
| 19 | 20 | E44D; Y307S; | * | 37 | + |
| 21 | 22 | I22M; S148T; | * | 37 | + |
| 23 | 24 | E290D; | * | 37 | + |
| 25 | 26 | R27A; | * | 40 | − |
| 27 | 28 | V253A; Y307N; | * | 40 | − |
| 29 | 30 | R27A; Y48H; | * | 40 | − |
| 31 | 32 | A60T; | * | 40 | + |
| 33 | 34 | D114G; | * | 40 | + |
| 35 | 36 | F185L; | * | 40 | − |
| 37 | 38 | N31S; | * | 40 | − |
| 39 | 40 | L296V; | * | 40 | − |
| 41 | 42 | E78K; A160T; | * | 40 | − |
| 43 | 44 | N40Y; S233C; | * | 40 | − |
| 45 | 46 | Q214H; | * | 40 | − |
| 47 | 48 | V248I; | * | 40 | − |
| 49 | 50 | E62Q; F185I; | * | 40 | − |
| 51 | 52 | A60T; | * | 40 | + |
| 53 | 54 | R27A; Y48H; A160T; | * | 40 | − |
| 55 | 56 | I22M; A101V; G112R; A160T; Y307S; | * | 40 | − |
| 57 | 58 | R27A; Y307S; | * | 40 | − |
| 59 | 60 | R27K; K51E; S148T; I237N; | * | 40 | + |
| 61 | 62 | A60T; D102G; I237N; | * | 40 | + |
| 63 | 64 | I237N; | * | 40 | + |
| 65 | 66 | R27A; Y48H; A160T; | * | 40 | − |
| 67 | 68 | A60T; I237N; | * | 40 | + |
| 69 | 70 | I22M; A60T; I237N; | * | 40 | + |
| 71 | 72 | R27A; A160T; K261R; | * | 40 | − |
| 73 | 74 | I22M; I237N; V253A; | * | 40 | + |
| 75 | 76 | I22M; E44D; I237N; E290Q; | * | 40 | + |
| 77 | 78 | A160T; E290D; | * | 40 | − |
| 79 | 80 | I22M; I237N; E290D; | * | 40 | + |
| 81 | 82 | G112R; A160T; Y307S; | * | 40 | − |
| 83 | 84 | I22M; T77A; G112R; A160T; | * | 40 | − |
| 85 | 86 | I22M; I237N; | * | 40 | + |
| 87 | 88 | N31S; I237N; | * | 40 | + |
| 89 | 90 | A60T; I237T; | * | 40 | + |
| 91 | 92 | A160T; Y307S; | * | 40 | − |
| 93 | 94 | K147R; A160T; I237N; Y307S; | * | 40 | + |
| 95 | 96 | R27K; A160T; I237N; | * | 40 | + |
| 97 | 98 | R27K; K79R; A160T; | * | 40 | − |
| 99 | 100 | R27A; G112R; A160T; I237N; | * | 40 | − |
| 101 | 102 | A60T; K195R; I237N; | * | 40 | + |
| 103 | 104 | A160T; | * | 40 | − |
| 105 | 106 | I63V; E78K; A160T; Q214R; | * | 40 | − |
| 107 | 108 | K51E; Y194C; | * | 40 | − |
| 109 | 110 | N31S; I237T; | * | 40 | − |
| 111 | 112 | R27K; A160T; Q214R; I237N; | ** | 40 | + |
| 113 | 114 | R27K; A160T; S233G; I237N; | ** | 40 | − |
| 115 | 116 | R27K; D114N; A160T; I237N; V248I; | ** | 40 | − |

TABLE 1-continued

| Nucleic Acid SEQ ID NO. | Protein SEQ ID NO. | Residue substitutions | Activity | temperature for stability test (° C.) | Stability |
|---|---|---|---|---|---|
| 117 | 118 | R27K; A160T; I237N; V253A; | * | 40 | + |
| 119 | 120 | R27K; V43F; A160T; I237N; | ** | 40 | − |
| 121 | 122 | R27K; A160T; V229I; I237N; | * | 40 | + |
| 123 | 124 | R27K; F125L; A160T; I237N; | ** | 40 | − |
| 125 | 126 | R27K; L121I; A160T; I237N; | * | 40 | + |
| 127 | 128 | R27K; A160T; I237N; K261M; | ** | 40 | − |
| 129 | 130 | A160S; I237R; | ** | 40 | + |
| 131 | 132 | A160S; I237G; | ** | 40 | + |
| 133 | 134 | A160S; I237Q; | ** | 40 | + |
| 135 | 136 | R27K; L76M; A160T; I237N; | * | 40 | + |
| 137 | 138 | R27K; S148R; A160T; I237N; | ** | 40 | − |
| 139 | 140 | R27K; A160T; I237N; S239T; | * | 40 | + |
| 141 | 142 | R27K; A160T; S222R; Q223H; I237N; | * | 40 | + |
| 143 | 144 | R27K; V47L; A160T; D221V; I237N; | * | 40 | + |
| 145 | 146 | R27K; A160T; I237N; L296Q; | ** | 40 | − |
| 147 | 148 | R27K; A160S; Q214R; I237N; | ** | 43 | + |
| 149 | 150 | R27K; Y48H; A160T; Q214R; I237N; | *** | 43 | − |
| 151 | 152 | R27K; K51E; I63V; L121I; A160T; Q214R; I237G; | ** | 43 | + |
| 153 | 154 | R27K; N31S; L121I; A160T; Q214R; K215M; I237N; | *** | 43 | + |
| 155 | 156 | R27A; N31S; A160T; H200L; Q214R; K215E; I237N; | *** | 43 | − |
| 157 | 158 | R27A; N31S; A160T; Q214R; I237N; V312E; | *** | 43 | − |
| 159 | 160 | R27K; N31S; I58V; A160T; Q214R; I237N; I265V; | *** | 43 | − |
| 161 | 162 | R27A; N31S; Y48H; A160T; Q214R; I237N; | *** | 43 | − |
| 163 | 164 | R27K; A160T; G192D; Q214R; I237N; K250E; | *** | 43 | − |
| 165 | 166 | R27K; I63V; L121I; F125L; A160T; Q214R; I237N; | ** | 43 | + |
| 167 | 168 | R27K; K152R; A160T; Q214R; I237N; | *** | 43 | − |
| 169 | 170 | R27A; N31S; A160T; Q214R; I237N; | *** | 43 | − |
| 171 | 172 | R27K; G103S; A160T; Q214R; I237N; | ** | 43 | + |
| 173 | 174 | R27K; A60T; I84V; A160T; Q214R; I237N; | * | 43 | + |
| 175 | 176 | R27K; A160T; Q214R; I237R; Y307S; | *** | 43 | − |
| 177 | 178 | R27A; N31S; F125L; A160T; K169R; Q214R; I237N; | *** | 43 | − |
| 179 | 180 | R27K; Q144R; A160T; Q214R; I237N; | ** | 43 | + |
| 181 | 182 | R27K; L121I; A160T; Q214R; I237D; | *** | 43 | + |
| 183 | 184 | R27K; N31S; A160T; Q214R; I237N; Y307S; | *** | 43 | − |
| 185 | 186 | R27K; L121I; A160T; Y194C; Q214R; I237N; | *** | 43 | + |
| 187 | 188 | R27K; N31S; E78K; A160T; Q214R; T217A; S222G; I237N; | *** | 43 | − |
| 189 | 190 | R27K; L121I; A160T; Q214R; I237G; | ** | 43 | + |
| 191 | 192 | R27K; A160T; Q214R; Q223H; I237N; | ** | 43 | + |
| 193 | 194 | R27K; E78K; A160T; Q214R; I237N; Y307S; | *** | 43 | − |
| 195 | 196 | R27A; N31S; L121I; A160T; Q214R; I237N; | *** | 43 | + |
| 197 | 198 | R27K; L121I; A160T; Y194C; Q214R; I237N; | *** | 43 | + |
| 199 | 200 | R27K; N31S; L121I; A160T; Q214R; I237N; | *** | 43 | + |
| 201 | 202 | R27K; N31S; A160T; Q214R; I237G; | *** | 43 | − |
| 203 | 204 | I19T; R27K; N31S; A160T; Q214R; I237G; | *** | 43 | − |

TABLE 1-continued

| Nucleic Acid SEQ ID NO. | Protein SEQ ID NO. | Residue substitutions | Activity | temperature for stability test (° C.) | Stability |
|---|---|---|---|---|---|
| 205 | 206 | R27K; I63V; A160T; Q214R; I237N; | ** | 43 | + |
| 207 | 208 | R27K; N31S; K51E; A160T; Q214R; I237N; K304R; | *** | 43 | − |
| 209 | 210 | R27K; N31S; L121I; A160T; Y194C; Q214R; I237R; | *** | 43 | + |
| 211 | 212 | R27K; A160T; G192D; Q214R; I237N; Y307S; | *** | 43 | − |
| 213 | 214 | R27A; N31S; A160T; Y194C; Q214R; I237R; | *** | 43 | − |
| 215 | 216 | R27K; E78K; L121I; A160T; Q214R; K216R; I237G; | ** | 43 | + |
| 217 | 218 | R27K; A160T; Q214R; I237G; | ** | 43 | + |
| 219 | 220 | R27K; I56V; A160T; Q214R; I237N; | ** | 43 | + |
| 221 | 222 | R27K; N31S; I63V; A160T; Q214R; I237N; | ** | 43 | + |
| 223 | 224 | R27K; A160T; Q214R; I237N; K250R; | *** | 43 | − |
| 225 | 226 | R27K; V130G; A160T; Q214R; I237N; | *** | 43 | − |
| 227 | 228 | R27K; L121I; A160T; Q214R; I237N; | ** | 43 | + |
| 229 | 230 | R27K; A160T; Q189H; Q214R; I237N; L287R; | ** | 43 | + |
| 231 | 232 | R27K; A73P; A160T; D201V; Q214R; I237G; | *** | 43 | − |
| 233 | 234 | R27K; A160T; Q214R; I237N; Y307H; | *** | 43 | − |
| 235 | 236 | R27K; N31S; L121I; A160T; Y194C; Q214R; I237N; | *** | 43 | + |
| 237 | 238 | R27K; N31S; L121I; A160S; Y194C; Q214R; I237N; | *** | 43 | + |
| 239 | 240 | R27K; N31S; S148T; A160T; Q214R; I237N; Y307S; | *** | 43 | − |
| 241 | 242 | R27K; L121I; A160S; Y194C; Q214R; I237N; | *** | 43 | + |
| 243 | 244 | R27K; N31S; E78K; A160T; Q214R; I237G; Y307S; | *** | 43 | − |
| 245 | 246 | R27K; N31S; L121I; S127T; A160T; Y194C; Q214R; I237N; | *** | 43 | + |
| 247 | 248 | R27A; N31S; L121I; A160S; Y194C; Q214R; I237N; | **** | 43 | + |
| 249 | 250 | R27K; N31S; L121I; S148T; A160T; Y194C; Q214R; I237N; | **** | 43 | + |
| 251 | 252 | R27K; N31S; L121I; A160T; Y194C; Q214R; I237G; | **** | 43 | + |
| 253 | 254 | R27K; N31S; L106I; L121I; A160S; Y194C; Q214R; I237N; | **** | 43 | + |
| 255 | 256 | R27A; N31S; L121I; A160S; Q214R; I237N; | **** | 43 | + |
| 257 | 258 | R27K; N31S; L121I; S148T; A160S; Y194C; Q214R; I237N; | **** | 43 | + |
| 259 | 260 | R27A; N31S; F125L; A160T; Y194C; Q214R; I237N; | **** | 45 | − |
| 261 | 262 | R27A; N31S; F125L; A160T; K169R; Q214R; I237N; | **** | 45 | − |
| 263 | 264 | R27A; N31S; F125L; A160T; Q214R; I237R; | **** | 45 | − |
| 265 | 266 | R27K; N31S; L121I; F125L; A160T; Y194C; Q214R; K215M; I237N; | **** | 45 | + |
| 267 | 268 | R27A; N31S; S148T; A160T; K169R; Q214R; I237N; | **** | 45 | − |
| 269 | 270 | I21T; R27A; N31S; L121I; F125L; A160T; Q214R; I237N; | **** | 45 | − |
| 271 | 272 | R27A; N31S; F125L; A160T; Y194C; Q214R; I237R; | **** | 45 | − |
| 273 | 274 | R27A; N31S; F125L; A160T; Q214R; I237N; | **** | 45 | − |
| 275 | 276 | R27A; N31S; L121I; F125L; A160T; Y194C; Q214R; I237N; | **** | 45 | − |
| 277 | 278 | R27A; N31P; L121I; F125L; A160T; Y194C; Q214R; I237N; | **** | 48 | − |

TABLE 1-continued

| Nucleic Acid SEQ ID NO. | Protein SEQ ID NO. | Residue substitutions | Activity | temperature for stability test (° C.) | Stability |
|---|---|---|---|---|---|
| 279 | 280 | I19V; R27A; N31S; E44D; K72R; D105E; L121I; F125L; A160T; F185L; Y194C; Q214R; I237N; I243V; L290D; | **** | 48 | − |
| 281 | 282 | Q6E; R27A; N31S; S41T; L121I; F125L; A160T; Y194C; E199Q; Q214R; I237N; L271I; | **** | 48 | + |
| 283 | 284 | Q6E; R27A; N31S; S41T; I46L; I55Y; L121I; F125L; A160T; Y194C; E199Q; Q214R; I237N; | **** | 48 | + |
| 285 | 286 | Q6E; R27A; N31S; S41T; I46L; F125L; Q144E; A160T; Y194C; E199Q; Q214R; I237N; S239T; L271I; | **** | 48 | + |
| 287 | 288 | Q6E; R27A; N31S; I46L; L121I; F125L; A160T; Y194C; Q214R; I237N; S239T; I244L; | **** | 48 | + |
| 289 | 290 | Q6E; R27A; N31S; L121I; F125L; A160T; Y194C; Q214R; I237N; S239T; | **** | 48 | + |
| 291 | 292 | Q6E; R27A; N31S; S41T; L121I; F125L; A160T; Y194C; Q214R; I237N; L271I; | **** | 48 | + |
| 293 | 294 | Q6E; R27A; N31S; L121I; F125L; A160T; Y194C; Q214R; E234Q; I237N; S239T; | **** | 48 | + |
| 295 | 296 | Q6E; R27A; N31S; I58L; F125L; A160T; Y194C; E199Q; Q214R; I237N; I244L; | **** | 48 | − |
| 297 | 298 | Q6E; R27A; N31S; I46L; L121I; F125L; A160T; Y194C; E199Q; Q214R; I237N; S239T; I244L; | **** | 48 | + |
| 299 | 300 | Q6E; R27A; N31S; I58L; L86I; L121I; F125L; A160T; Y194C; Q214R; I237N; S239T; I244L; | **** | 48 | + |
| 301 | 302 | Q6E; R27A; N31S; I46L; L121I; F125L; A160T; Y194C; Q214R; I237N; S239T; | **** | 48 | + |
| 303 | 304 | Q6E; R27A; N31S; L121I; F125L; A160T; Y194C; Q214R; I237N; L271I; | **** | 48 | + |
| 305 | 306 | Q6E; R27A; N31S; I46L; I58L; L121I; F125L; Q144E; A160T; Y194C; Q214R; I237N; A309T; | **** | 48 | − |
| 307 | 308 | Q6E; R27A; N31S; L121I; F125L; Q144E; A160T; Q165E; Y194C; E199Q; Q214R; I237N; S239T; I244L; Y305H; | **** | 48 | − |
| 309 | 310 | Q6E; R27A; N31S; S41T; I46L; L121I; F125L; A160T; Y194C; Q214R; I237N; | **** | 48 | + |
| 311 | 312 | Q6E; R27A; N31S; S41T; I46L; L121I; F125L; A160T; Y194C; Q214R; I237N; | **** | 48 | + |
| 313 | 314 | Q6E; R27A; N31P; I46L; L86I; L121I; F125L; A160T; Y194C; Q214R; I237N; S239T; | **** | 50 | + |
| 315 | 316 | R27A; N31P; I63W; L121I; F125L; A160T; Y194C; Q214R; I237N; | **** | 50 | − |
| 317 | 318 | R27A; N31P; I63W; L121I; F125L; A160T; Y194C; Q214R; I237N; | **** | 50 | − |
| 319 | 320 | R27A; N31P; L121I; F125L; A160T; Y194C; Q214R; I237N; Y297W; | **** | 50 | − |
| 321 | 322 | R27A; N31P; L121I; F125L; A160T; Y194C; Q214R; I237N; L301R; | **** | 50 | − |
| 323 | 324 | R27A; N31P; L121I; F125L; A160T; Y194C; Q214R; I237N; L301K; | **** | 50 | − |

TABLE 1-continued

| Nucleic Acid SEQ ID NO. | Protein SEQ ID NO. | Residue substitutions | Activity | temperature for stability test (° C.) | Stability |
|---|---|---|---|---|---|
| 325 | 326 | R27A; N31P; I63W; L121I; F125L; A160T; Y194C; Q214R; I237N; Y297W; | **** | 50 | − |
| 327 | 328 | R27A; N31P; I63W; L121I; F125L; A160T; Y194C; Q214R; I237N; Y297W; L301K; | **** | 50 | − |
| 329 | 330 | Q6E; R27A; N31P; I46L; I63W; L86I; L121I; F125L; A160T; Y194C; Q214R; I237N; S239T; | **** | 50 | + |
| 331 | 332 | R27A; N31P; I63W; L121I; F125L; A160T; Y194C; Q214R; I237N; Y297W; L301A; | **** | ND | ND |
| 333 | 334 | R27A; N31P; I63W; L121I; F125L; A160T; Y194C; Q214R; I237N; Y297W; L301S; | **** | ND | ND |
| 335 | 336 | R27A; N31P; I63W; L121I; F125L; A160T; Y194C; Q214R; I237N; Y297W; L301E; | **** | ND | ND |
| 337 | 338 | R27A; N31P; I63W; L121I; F125L; A160T; Y194C; Q214R; I237N; Y297W; L301P; | **** | ND | ND |
| 339 | 340 | R27A; N31P; I63W; L121I; F125L; A160T; Y194C; Q214R; I237N; Y297W; L301Q; | **** | ND | ND |
| 341 | 342 | R27A; N31P; I63W; L121I; F125L; A160T; Y194C; Q214R; I237N; L301E; | **** | 50 | − |
| 343 | 344 | R27A; N31P; S41G; I63W; L121I; F125L; A160T; Y194C; Q214R; I237N; L301A; | **** | 50 | − |
| 345 | 346 | R27A; N31P; I63W; L121I; F125L; A160T; Y194C; Q214R; I237N; Y297F; L301E; | **** | 50 | − |
| 347 | 348 | R27A; N31P; I63W; R65G; L121I; F125L; A160T; Y194C; Q214R; I237N; Y297W; L301Q; | **** | 50 | − |
| 349 | 350 | R27A; N31P; I63W; R65S; L121I; F125L; A160T; Y194C; Q214R; I237N; Y297W; L301Q; | **** | 50 | − |
| 351 | 352 | R27A; N31P; A36V; I63W; L121I; F125L; A160T; Y194C; Q214R; I237N; Y297W; L301Q; | **** | 50 | − |
| 353 | 354 | R27A; N31P; I63W; L121I; F125L; A160T; Y194C; Q214R; I237N; Y297W; L301Q; Q310R; K311E; V312S; *313V; | **** | 50 | − |
| 355 | 356 | R27A; N31P; I63W; L121I; F125L; A160T; Y194C; Q214R; A218T; I237N; Y297W; L301Q; | **** | 50 | − |
| 357 | 358 | R27A; N31P; I63W; L121I; F125L; A160T; Y194C; Q214R; I237N; Y297W; L301Q; Q310P; K311E; V312S; *313V; | **** | 50 | − |
| 359 | 360 | Q6E; R27A; N31P; I46L; I63W; L86I; L121I; F125L; A160T; Y194C; Q214R; I237N; S239T; L301E; | **** | ND | ND |
| 361 | 362 | Q6E; R27A; N31P; I46L; L86I; L121I; F125L; A160T; Y194C; Q214R; I237N; S239T; Y297W; | **** | ND | ND |
| 363 | 364 | Q6E; R27A; N31P; I46L; I63W; L86I; L121I; F125L; A160T; Y194C; Q214R; I237N; S239T; Y297W; | **** | ND | ND |

TABLE 1-continued

| Nucleic Acid SEQ ID NO. | Protein SEQ ID NO. | Residue substitutions | Activity | temperature for stability test (° C.) | Stability |
|---|---|---|---|---|---|
| 365 | 366 | Q6E; R27A; N31P; I46L; I63W; L86I; L121I; F125L; A160T; Y194C; Q214R; I237N; S239T; Y297W; L301Q; | **** | ND | ND |

\* = 150-500% enzymatic activity of SEQ ID NO: 2
\*\* = 500-900% enzymatic activity of SEQ ID NO: 2
\*\*\* = 900-1600% enzymatic activity of SEQ ID NO: 2
\*\*\*\* = greater than 1600% enzymatic activity of SEQ ID NO: 2
+ = variant retains residual activity after heat treatment at indicated temperature for 16 hrs.
ND = Not Determined In other embodiments, the engineered ketoreductase comprises a ketoreductase with improved thermal stability as compared to the naturally occurring ketoreductase from which the engineered enzymes are derived. Thermally stable enzymes allow longer incubations with substrate, such as in conditions of high substrate concentrations used in large scale production, and also minimize the amount of enzyme needed. An enzyme that has "improved thermal stability" refers to an enzyme that displays increased resistance to inactivation when exposed to a set temperature or set of temperatures in defined assay conditions as compared to the resistance to inactivation of a reference enzyme.

A number of methods are available for measuring enzyme thermal stability. Enzymes may be treated for a defined time period at various temperatures under a standard set of assay conditions (e.g., ionic strength, pH, protein concentration, etc.). Half-inactivation temperatures, i.e., temperatures at which 50% inactivation occurs after heat treatment for the defined time are used to compare the thermal stabilities of the enzymes. Another method of determining thermal stability is to treat the enzyme at a set temperature and measure the amount of enzyme activity remaining. The amount of enzyme activity remaining is compared to the activity remaining of the naturally occurring enzyme prepared under similar or identical conditions. Useful temperatures for analysis of thermal stability are temperature encompassing the reaction temperature for used for carrying out the reaction, for example as in large scale reactions, and/or temperatures at which the engineered enzymes have been selected for improved thermal stability. For example, the engineered enzymes can have improved thermal stability as compared to a reference enzyme (e.g., a naturally occurring enzyme) at temperatures of about 30° C. or above, about 35° C. or above, 40° C. or above, 45° C. or above, 50° C. or above, 55° C. or above, to about 65° C. In some embodiments, the enzyme can have an improved thermal stability in which the engineered enzyme retains, as compared to a reference enzyme, about 10% or more activity, about 15% or more activity, about 20% or more activity, about 30% or more activity, about 50% or more activity, about 70% or more activity, about 90% or more activity. Under the conditions of treatment, the times at which enzyme activity shows enhanced thermal stability can include, about 5 hrs or more, about 6 hrs or more, about 12 hrs or more, about 18 hrs or more, about 24 hrs or more, about 36 hrs or more, about 48 hrs or more, about 72 hrs or more. Substrate may or may not be present during thermal treatment, although presence of substrate is known to stabilize enzyme structures in some instances.

In other embodiments, the thermal stability of an enzyme can be measured by determining protein folding stability, such as by detecting protein unfolding with calorimetry or circular dichroism. For example, to determine the thermal stability of the engineered and naturally occurring ketoreductase, changes in CD profile at various temperatures can be used. An Arrhenius plot of the unfolding rate constants of the enzymes is generated by use of temperature jumps (e.g., from a temperature where an enzyme is active to a temperature where the enzyme is inactive) and measuring changes in protein structure. The first-order rate constants, activation enthalpies, and activation free energies between the stable and transition state of the unfolding reaction at an inactivating temperature may be compared. Typically, the activation free energy increases with more thermally stable enzymes. Other methods for determining thermal stability will be apparent to the skilled artisan.

In some embodiments, the improved thermal stability is separable from other properties of the ketoreductase enzymes, while in other embodiments, the thermal stability is also observed with another improved property. In some embodiments, the ketoreductases comprise engineered ketoreductases with improved thermal stability is derived from the *Saccharomyces cerevisiae* ketoreductase of SEQ ID NO:2. In some embodiments, the engineered ketoreductase with improved thermal stability retains about 20% or more of enzyme activity following treatment at temperature ranging from 37 to 50° C. for 16 hrs at pH 7.0. By comparison, the naturally occurring ketoreductase of SEQ ID NO:2 retains only 5-10% of its activity after incubation at 37° C. for 16 hrs at pH 7.0 and retains essentially no activity when incubated at higher temperatures under the same conditions.

In some embodiments, the engineered ketoreductases with improved thermal stability comprises an amino acid sequence corresponding to SEQ ID NO:2 and includes one or more of the following substitutions:

$X^6$ is a polar or acidic amino acid residue;
$X^{31}$ is a hydroxyl containing or aliphatic amino acid residue;
$X^{44}$ is an acidic amino acid residue;
$X^{46}$ is an aliphatic amino acid residue
$X^{55}$ is an aliphatic amino acid residue;
$X^{56}$ is an aliphatic amino acid;
$X^{60}$ is an hydroxyl containing or small amino acid;
$X^{63}$ is a hydrophobic or aromatic amino acid;
$X^{76}$ is a amino acid residue M;
$X^{103}$ is a hydroxyl containing amino acid residue;
$X^{106}$ is an aliphatic amino acid residue;
$X^{114}$ is a small amino acid residue;

$X^{121}$ is a hydrophobic or aliphatic amino acid residue;
$X^{144}$ is a hydrophilic or basic amino acid residue
$X^{148}$ is a hydroxyl containing amino acid residue
$X^{158}$ is an aromatic amino acid residue
$X^{160}$ is a hydroxyl containing or small amino acid residue;
$X^{165}$ is a polar or acidic amino acid residue;
$X^{169}$ is a aliphatic or basic amino acid residue;
$X^{185}$ is an aromatic or aliphatic amino acid residue;
$X^{194}$ is an aromatic amino acid or polar hydrophilic amino acid residue
$X^{199}$ is a polar amino acid residue;
$X^{214}$ is an aromatic or basic amino acid residue;
$X^{223}$ is an aromatic amino acid residue;
$X^{234}$ is a polar hydrophilic amino acid residue;
$X^{237}$ is a hydrophilic or small amino acid residue;
$X^{239}$ is a hydroxyl containing amino acid residue;
$X^{253}$ is an aliphatic amino acid residue; and/or
$X^{263}$ is a acidic or polar amino acid residue.

In some embodiments, $X^{63}$ is an aromatic residue. In some embodiments, $X^{63}$ is tryptophan. In some embodiments, the ketoreductase comprises one or more conservative mutations at other positions than those listed above.

In some embodiments, the engineered ketoreductases with improved thermal stability comprises an amino acid sequence corresponding to SEQ ID NO:2 and includes one or more of the following substitutions:
$X^6$ is E;
$X^{31}$ is P;
$X^{44}$ is D;
$X^{46}$ is L;
$X^{55}$ is V;
$X^{56}$ is V;
$X^{60}$ is T;
$X^{63}$ is V;
$X^{76}$ is M;
$X^{103}$ is S;
$X^{106}$ is I;
$X^{114}$ is G;
$X^{121}$ is I or M;
$X^{144}$ is R;
$X^{148}$ is T;
$X^{158}$ is H;
$X^{160}$ is S;
$X^{165}$ is E;
$X^{214}$ is R or H;
$X^{223}$ is H, R or G;
$X^{234}$ is Q;
$X^{237}$ is N, G, R or Q;
$X^{239}$ is T; and/or
$X^{253}$ is A.

In some embodiments, the engineered ketoreductase with improved thermal stability have substitutions in a subset of the amino acid residues indicated above. Thus, in some embodiments the amino acid substitutions can occur at one or more of the amino acid positions $X^{44}$, $X^{46}$, $X^{55}$, $X^{56}$, $X^{60}$, $X^{63}$, $X^{76}$, $X^{103}$, $X^{106}$, $X^{114}$, $X^{121}$, $X^{144}$, $X^{148}$, $X^{158}$, $X^{223}$, $X^{237}$, $X^{239}$, and $X^{253}$, wherein the amino acid residues for substitution are selected as indicated above.

In some embodiments, the engineered ketoreductase with improved thermal stability comprises one or more of the following substitutions as compared to SEQ ID NO:2: E44D, I46L, I55V, I56V, A60T, I63V, L76M, G103S, L106I, D114G, L121I, Q144R, S148T, N158H, Q223H, I237G, I237N, I237R, S239T, and V253A.

As observed for the engineered ketoreductases with improved enzymatic activity, various amino acid residue positions whose substitutions result in an engineered ketoreductase with improved thermal stability are also found to cluster in certain segments of the ketoreductase of SEQ ID NO:2, which allows targeted modifications. Substitutions resulting in improved thermal stability overlap with those that occur in engineered enzymes with improved enzymatic activity, although some do not. Accordingly, in some embodiments, selected segments of the ketoreductase polypeptide may be subject to modification to generate engineered ketoreductases with improved thermal stability. For the reference sequence of SEQ ID NO:2, the segments affecting ketoreductase enzymatic activity include, among others, those represented by amino acid residues 27 to 36, 40 to 65, 103 to 125, 144 to 169, 233 to 265, and 287 to 312. In some embodiments, the segments affecting ketoreductase enzymatic activity include, among others, those represented by amino acid residues 27-32, 60-65, 90-93, 120-125, 157-159, 208-211, and 293-306. One or more of the amino acid residues in each segment or combination of segments may be modified.

In some embodiments, the corresponding amino acid sequences and positions for substitutions comprise:
$X^{27}$WYKX$^{31}$EETDX$^{36}$
$X^{40}$SLX$^{43}$X$^{44}$QX$^{46}$VX$^{48}$ALX$^{51}$LPGX$^{55}$X$^{56}$HX$^{58}$DX$^{60}$AX$^{62}$X$^{63}$YX$^{65}$
$X^{103}$LDX$^{106}$ALKK MGTX$^{114}$YVDLYLX$^{121}$HSPX$^{125}$
$X^{144}$LYKX$^{148}$GKAX$^{152}$NIGVSX$^{158}$F
$X^{160}$VEDLX$^{165}$RILX$^{169}$
$X^{233}$X$^{234}$KYX$^{237}$KX$^{239}$EAQIILRWX$^{248}$TX$^{250}$RGX$^{253}$LPVTTSS KPX$^{263}$RX$^{265}$; and
$X^{290}$HEPLRX$^{296}$X$^{297}$WNKX$^{301}$YGKYNX$^{307}$AAX$^{310}$X$^{311}$X$^{312}$ wherein $X^n$ indicates positions of the amino acid substitutions. Both conservative and non-conservative substations can be made in the segments as indicated.

In some embodiments, the improved property can be a combination of properties, such as improved enzymatic activity and improved thermal stability. In some embodiments, the engineered ketoreductase comprises a ketoreductase with a combination of improved enzyme activity and improved enzyme stability having a amino acid sequence that corresponds to the wild type sequence of the ketoreductase of SEQ ID NO:2 and includes one or more mutations selected from: Q6E, N31P, A160S, Q165E, Q214H, Q214R, E234Q, Q263E.

In some embodiments, the engineered ketoreductase comprises a ketoreductase with a combination of improved enzyme activity and/or stability having an amino acid sequence that corresponds to the wild type sequence of the ketoreductase SEQ ID NO:2 and includes one or more mutations selected from: N40Y, V43L, K51E, I58V, E62Q, A73P, K79R, K152Q, K169E, F185I, Q189H, G192D, H200L, D201G, K215E, K215M, K216R, D221V, S233C, I237D, K250E, I265V, L287R, K304R, Q310R, K311E, V312S, V312E.

It is to be understood that the engineered ketoreductases are not limited to those identified directly by mutagenesis or other gene evolution techniques, but also include variants or analogs of the improved engineered ketoreductase polypeptides. The term "variant" or "analog" as used herein refers to polypeptides which are comprised of a segment having ketoreductase activity, with or without retention of the improved property, and has substantial identity to a portion of the engineered ketoreductase. In some embodiments, analog polypeptides comprise a conservative amino acid substitution, or addition or deletion of one or more amino acid residues with respect to the engineered sequence. Analogs typically are at least an enzymatically active fragment and typically as long as the full-length naturally-occurring reference polypeptide of SEQ ID NO:2 (e.g., 312 amino acid residues).

In some embodiments, the variant or analog of the engineered ketoreductase polypeptides can comprise an enzymatically active ketoreductase polypeptide that has about 70% or more amino acid identity, about 80% or more amino acid identity, about 90% or more amino acid identity, about 95% or more amino acid identity, about 97% or more amino acid identity, about 98% or more amino acid identity, or about 99% or more amino acid identity to a reference engineered ketoreductase or an enzymatically active fragment of an engineered ketoreductase.

In some embodiments, the reference engineered ketoreductase is selected from the amino acid sequences recited in Table 1. An exemplary reference sequence of an improved ketoreductase is SEQ ID NO:314. In some embodiments, the variant or analog of the engineered ketoreductase polypeptides can comprise an enzymatically active ketoreductase polypeptide that has about 95.5% or more amino acid identity, about 97% or more amino acid identity, about 98% or more amino acid identity, or about 99% or more amino acid identity to SEQ ID NO:314, or an enzymatically active fragment of SEQ ID NO:314.

Another exemplary reference sequence of an improved ketoreductase is SEQ ID NO:316. In some embodiments, the variant or analog of the engineered ketoreductase polypeptides can comprise an enzymatically active ketoreductase polypeptide that has about 95.5% or more amino acid identity, about 97% or more amino acid identity, about 98% or more amino acid identity, or about 99% or more amino acid identity to SEQ ID NO:316 or an enzymatically active fragment of SEQ ID NO:316.

Another exemplary reference sequence of an improved ketoreductase is SEQ ID NO:318. In some embodiments, the variant or analog of the engineered ketoreductase polypeptides can comprise an enzymatically active ketoreductase polypeptide that has about 95.5% or more amino acid identity, about 97% or more amino acid identity, about 98% or more amino acid identity, or about 99% or more amino acid identity to SEQ ID NO:318 or an enzymatically active fragment of SEQ ID NO:318.

Another exemplary reference sequence of an improved ketorreductase is SEQ ID NO:376. In some embodiments, the variant or analog of the engineered ketoreductase polypeptides can comprise an enzymatically active ketoreductase polypeptide that has about 95.5% or more amino acid identity, about 97% or more amino acid identity, about 98% or more amino acid identity, or about 99% or more amino acid identity to SEQ ID NO:376 or an enzymatically active fragment of SEQ ID NO:376.

In some embodiments, segments of the improved ketoreductase polypeptides can be deleted to generate polypeptide fragments. The term "fragment" as used herein refers to a polypeptide that has an amino-terminal and/or carboxy-terminal deletion, but where the remaining amino acid sequence is identical to the corresponding positions in the sequence. Fragments can be at least 14 amino acids long, at least 20 amino acids long, at least 50 amino acids long or longer, and up to 70%, 80%, 90%, 95%, 98%, and 99% of the full-length naturally-occurring ketoreductase polypeptide of SEQ ID NO:2.

The improved ketoreductase enzymes may be present within a cell, present in the cellular medium, or prepared in various forms, such as lysates or isolated preparations. As such, in some embodiments, the improved ketoreductase enzyme can be an isolated polypeptide. The term "isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis).

In some embodiments, the isolated improved ketoreductases polypeptide is a substantially pure polypeptide composition. The term "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure ketoreductase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species.

7.3 Polynucleotides Encoding Engineered Ketoreductases

In another aspect, the present disclosure provides polynucleotides encoding the engineered ketoreductase enzymes. The polynucleotides may be operatively linked to one or more heterologous regulatory sequences that control gene expression to create a recombinant polynucleotide capable of expressing the polypeptide. Expression constructs containing a heterologous polynucleotide encoding the engineered ketoreductase can be introduced into appropriate host cells to express the corresponding ketoreductase polypeptide. The term "heterologous" polynucleotide refers to any polynucleotide that is introduced into a host cell by laboratory techniques, and includes polynucleotides that are removed from a host cell, subjected to laboratory manipulation, and then reintroduced into a host cell.

Because of the knowledge of the codons corresponding to the various amino acids, availability of a protein sequence provides a description of all the polynucleotides capable of encoding the subject. The degeneracy of the genetic code, where the same amino acids are encoded by alternative or synonymous codons allows an extremely large number of nucleic acids to be made, all of which encode the improved ketoreductase enzymes disclosed herein. Thus, having identified a particular amino acid sequence, those skilled in the art could make any number of different nucleic acids by simply modifying the sequence of one or more codons in a way which does not change the amino acid sequence of the protein. In this regard, the present disclosure specifically contemplates each and every possible variation of polynucleotides that could be made by selecting combinations based on the possible codon choices, and all such variations are to be considered specifically disclosed for any polypeptide disclosed herein, including the amino acid sequences presented in Table 1.

In some embodiments, the polynucleotides encoding the ketoreductases enzymes may be codon optimized for optimal production from the host organism selected for expression.

The term "codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome.

The terms "preferred," "optimal," or "high codon usage bias" codons refers interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression.

A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (see GCG CodonPreference, Genetics Computer Group Wisconsin Package; CodonW, John Peden, University of Nottingham; McInerney, J. O, 1998, Bioinformatics 14:372-73; Stenico et al., 1994, Nucleic Acids Res. 222437-46; Wright, F., 1990, Gene 87:23-29).

Codon usage tables are available for a growing list of organisms (see for example, Wada et al., 1992, *Nucleic Acids Res.* 20:2111-2118; Nakamura et al., 2000, *Nucl. Acids Res.* 28:292; Duret, et al., supra; Henaut and Danchin, "*Escherichia coli* and *Salmonella*," 1996, Neidhardt, et al. Eds., ASM Press, Washington D.C., p. 2047-2066. The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (see for example, Mount, D., *Bioinformatics: Sequence and Genome Analysis*, Chapter 8, Cold Spring Harbor Laboratory Press, Cold Spring Harbor, N.Y., 2001; Uberbacher, E. C., 1996, *Methods Enzymol.* 266: 259-281; Tiwari et al., 1997, *Comput. Appl. Biosci.* 13:263-270).

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. By way of example, the polynucleotide of SEQ ID NO: 1 has been codon optimized for expression in *E. coli*, but otherwise encodes the naturally occurring ketoreductase of *Saccharomyces cerevisiae*.

In certain embodiments, all codons need not be replaced to optimize the codon usage of the ketoreductases since the natural sequence will comprise preferred codons and because use of preferred codons may not be required for all amino acid residues. Consequently, codon optimized polynucleotides encoding the ketoreductase enzymes may contain preferred codons at about 40%, 50%, 60%, 70%, 80%, or greater than 90% of codon positions of the full length coding region.

In the embodiments, the polynucleotides encoding the engineered ketoreductases are derived from *Saccharomyces cerevisiae* ydl gene. In some embodiments, the polynucleotides encoding the engineered ketoreductases are selected from SEQ ID NOS: 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, and 365.

These polynucleotides encode the corresponding polypeptides represented by the amino acid sequences listed in Table 1, which were derived by subjecting the *E. coli* codon optimized *Saccharomyces* ydl gene to directed gene evolution techniques described herein.

In other embodiments, the polynucleotides comprise polynucleotides that have about 80% or more sequence identity, about 85% or more sequence identity, about 90% or more sequence identity, about 95% or more sequence identity, about 98% or more sequence identity, or 99% or more sequence identity at the nucleotide level to a reference polynucleotide encoding an engineered ketoreductase with improved enzymatic properties or a fragment of an engineered ketoreductase with improved properties. In some embodiments, the reference polynucleotide is selected from polynucleotide sequences represented by SED ID NOS: 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, and 365.

In some embodiments, the polynucleotide encodes an enzymatically active ketoreductase and hybridizes under defined conditions, such as moderately stringent or highly stringent conditions, to the complement of a sequence encoding an engineered ketoreductase enzyme of the present disclosure. The phrase "stringent hybridization" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (see, e.g., Baldino et al., *Methods Enzymology* 168: 761-777; Bolton et al., 1962, *Proc. Natl. Acad. Sci. USA*

48:1390; Bresslauer et al., 1986, *Proc. Natl. Acad. Sci. USA* 83:8893-8897; Freier et al., 1986, *Proc. Natl. Acad. Sci USA* 83:9373-9377; Kierzek et al., *Biochemistry* 25:7840-7846; Rychlik et al., 1990, *Nucleic Acids Res* 18:6409-6412 (erratum, 1991, *Nucleic Acids Res* 19:698); Sambrook et al., supra); Suggs et al., 1981, In *Developmental Biology Using Purified Genes* (Brown et al., eds.), pp. 683-693, Academic Press; and Wetmur, 1991, *Crit Rev Biochem Mol Biol* 26:227-259. All publications incorporate herein by reference).

Generally, hybridization reactions are performed under conditions of lower stringency, followed by washes of varying but higher stringency. Typically, reference to "hybridization stringency" relates to such washing conditions. The term "moderately stringent hybridization" refers to conditions that permit target-DNA to bind a complementary nucleic acid that has about 60% identity, preferably about 75% identity, about 85% identity to the target DNA; with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C.

The term "high stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Other high stringency hybridization conditions, as well as moderately stringent conditions, are described in the references cited above.

An isolated polynucleotide encoding an improved ketoreductase polypeptide may be manipulated in a variety of ways to provide for expression of the polypeptide. Manipulation of the isolated polynucleotide prior to its insertion into a vector may be desirable or necessary depending on the expression vector. The techniques for modifying polynucleotides and nucleic acid sequences utilizing recombinant DNA methods are well known in the art. Guidance is provided in Sambrook et al., 2001, *Molecular Cloning: A Laboratory Manual*, 3$^{rd}$ Ed., Cold Spring Harbor Laboratory Press; and *Current Protocols in Molecular Biology*, Ausubel. F. ed., Greene Pub. Associates, 1998, updates to 2006.

The term "control sequence" is defined herein to include all components, which are necessary or advantageous for the expression of a polypeptide of the present disclosure. Each control sequence may be native or foreign to the nucleic acid sequence encoding the polypeptide. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

The term "operably linked" is defined herein as a configuration in which a control sequence is appropriately placed at a position relative to the coding sequence of the DNA sequence such that the control sequence directs the expression of a polynucleotide and/or polypeptide.

The control sequence may be an appropriate promoter sequence. The "promoter sequence" is a nucleic acid sequence that is recognized by a host cell for expression of the coding region. The promoter sequence contains transcriptional control sequences, which mediate the expression of the polypeptide. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

For bacterial host cells, suitable promoters for directing transcription of the nucleic acid constructs of the present disclosure, include the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (Villa-Kamaroff et al., 1978, *Proc. Natl. Acad. Sci. USA* 75: 3727-3731), as well as the tac promoter (DeBoer et al., 1983, *Proc. Natl. Acad. Sci. USA* 80: 21-25). Further promoters are described in "Useful proteins from recombinant bacteria" in *Scientific American*, 1980, 242:74-94; and in Sambrook et al., supra.

For filamentous fungal host cells, suitable promoters for directing the transcription of the nucleic acid constructs of the present disclosure include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof.

In a yeast host, useful promoters can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are described by Romanos et al., 1992, *Yeast* 8:423-488.

The control sequence may also be a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice may be used in the present invention.

For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease.

Exemplary terminators for yeast host cells can be obtained from the genes for *Saccharomyces cerevisiae* enolase, *Saccharomyces cerevisiae* cytochrome C (CYC1), and *Saccharo-*

*myces cerevisiae* glyceraldehyde-3-phosphate dehydrogenase. Other useful terminators for yeast host cells are described by Romanos et al., 1992, supra.

The control sequence may also be a suitable leader sequence, a nontranslated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells can be from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are described by Guo and Sherman, 1995, *Mol Cell Bio* 15:5983-5990.

The control sequence may also be a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region.

Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used in the present invention.

Effective signal peptide coding regions for bacterial host cells are the signal peptide coding regions obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are described by Simonen and Palva, 1993, *Microbiol Rev* 57: 109-137.

Effective signal peptide coding regions for filamentous fungal host cells can be the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase.

Useful signal peptides for yeast host cells can be from the genes for *Saccharomyces cerevisiae* alpha-factor and *Saccharomyces cerevisiae* invertase. Other useful signal peptide coding regions are described by Romanos et al., 1992, supra.

The control sequence may also be a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (WO 95/33836).

Where both signal peptide and propeptide regions are present at the amino terminus of a polypeptide, the propeptide region is positioned next to the amino terminus of a polypeptide and the signal peptide region is positioned next to the amino terminus of the propeptide region.

It may also be desirable to add regulatory sequences, which allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include the lac, tac, and trp operator systems. In yeast host cells, suitable regulatory systems include, as examples, the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter.

Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the KRED polypeptide of the present invention would be operably linked with the regulatory sequence.

Thus, in another aspect, the present disclosure is also directed to a recombinant expression vector comprising a polynucleotide encoding an improved ketoreductase polypeptide or a variant thereof, and one or more expression regulating regions such as a promoter and a terminator, a replication origin, etc., depending on the type of hosts into which they are to be introduced. The various nucleic acid and control sequences described above may be joined together to produce a recombinant expression vector which may include one or more convenient restriction sites to allow for insertion or substitution of the nucleic acid sequence encoding the polypeptide at such sites. Alternatively, the nucleic acid sequence of the present disclosure may be expressed by inserting the nucleic acid sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), which can be conveniently subjected to recombinant DNA procedures and can bring about the expression of the polynucleotide sequence. The choice of the vector will typically depend on the compatibility of the vector with the host cell into which the vector is to be introduced. The vectors may be linear or closed circular plasmids.

The expression vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The expression vector of the present invention preferably contains one or more selectable markers, which permit easy selection of transformed cells. A selectable marker is a gene the product of which provides for biocide or viral resistance, resistance to heavy metals, prototrophy to auxotrophs, and the like. Examples of bacterial selectable markers are the dal genes from *Bacillus subtilis* or *Bacillus licheniformis*, or markers, which confer antibiotic resistance such as ampicillin, kanamycin, chloramphenicol (Example 1) or tetracycline resistance. Suitable markers for yeast host cells are ADE2, HIS3, LEU2, LYS2, MET3, TRP1, and URA3.

Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Embodiments for use in an *Aspergillus* cell include the amdS and pyrG genes of *Aspergillus nidulans* or *Aspergillus oryzae* and the bar gene of *Streptomyces hygroscopicus*.

The expression vectors of the present invention preferably contain an element(s) that permits integration of the vector into the host cell's genome or autonomous replication of the vector in the cell independent of the genome. For integration into the host cell genome, the vector may rely on the nucleic acid sequence encoding the polypeptide or any other element of the vector for integration of the vector into the genome by homologous or nonhomologous recombination.

Alternatively, the expression vector may contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements should preferably contain a sufficient number of nucleic acids, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A ori (as shown in the plasmid of FIG. 5) or the origins of replication of plasmids pBR322, pUC19, pACYC177 (which plasmid has the P15A ori), or pACYC184 permitting replication in *E. coli*, and pUB110, pE194, pTA1060, or pAMβ1 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it's functioning temperature-sensitive in the host cell (see, e.g., Ehrlich, 1978, *Proc Natl Acad Sci. USA* 75:1433).

More than one copy of a nucleic acid sequence of the present invention may be inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many of the expression vectors for use in the present invention are commercially available. Suitable commercial expression vectors include p3xFLAGTM™ expression vectors from Sigma-Aldrich Chemicals, St. Louis Mo., which includes a CMV promoter and hGH polyadenylation site for expression in mammalian host cells and a pBR322 origin of replication and ampicillin resistance markers for amplification in *E. coli*. Other suitable expression vectors are pBluescriptII SK(-) and pBK-CMV, which are commercially available from Stratagene, LaJolla Calif., and plasmids which are derived from pBR322 (Gibco BRL), pUC (Gibco BRL), pREP4, pCEP4 (Invitrogen) or pPoly (Lathe et al., 1987, *Gene* 57:193-201).

7.4 Host Cells for Expression of Ketoreductase Polypeptides

In another aspect, the present disclosure provides a host cell comprising a polynucleotide encoding an improved ketoreductase polypeptide of the present disclosure, the polynucleotide being operatively linked to one or more control sequences for expression of the ketoreductase enzyme in the host cell. Host cells for use in expressing the KRED polypeptides encoded by the expression vectors of the present invention are well known in the art and include but are not limited to, bacterial cells, such as *E. coli, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Appropriate culture mediums and growth conditions for the above-described host cells are well known in the art.

Polynucleotides for expression of the ketoreductase may be introduced into cells by various methods known in the art. Techniques include among others, electroporation, biolistic particle bombardment, liposome mediated transfection, calcium chloride transfection, and protoplast fusion. Various methods for introducing polynucleotides into cells will be apparent to the skilled artisan.

An exemplary host cell is *Escherichia coli* W3110 as described in Example 1. The expression vector was created by operatively linking a polynucleotide encoding an improved ketoreductase into the plasmid pCK110900 operatively linked to the lac promoter under control of the lacI repressor. The expression vector also contained the P15a origin of replication and the chloramphenicol resistance gene. Cells containing the subject polynucleotide in *Escherichia coli* W3110 were isolated by subjecting the cells to chloramphenicol selection.

7.5 Methods of Generating Engineered Ketoreductase Polypeptides

To make the improved KRED polynucleotides and polypeptides of the present disclosure, the naturally-occurring ketoreductase enzyme that catalyzes the reduction reaction is obtained from *Saccharomyces cerevisiae*. In some embodiments, the parent polynucleotide sequence is codon optimized to enhance expression of the ketoreductase in a specified host cell. As an illustration, the parental polynucleotide sequence encoding the wild-type KRED polypeptide (ydl) of *Saccharomyces cerevisiae* was constructed from oligonucleotides composed of 42 nucleotides based upon the known polypeptide sequence of *Saccharomyces cerevisiae* KRED sequence (ydl) available in Genbank database (NP_010159; GI: 6320079). The parental polynucleotide sequence, designated as SEQ ID NO: 1, was codon optimized for expression in *E. coli* and the codon-optimized polynucleotide cloned into the SfiI cloning sites of the expression vector, pCK110900 (depicted in FIG. 5), placing the expression of the ketoreductase gene under the control of the lac promoter and lacI repressor gene. The expression vector also contained the P15A origin of replication and the chloramphenicol resistance gene. Clones expressing the active ketoreductase in *E. coli* W3110 were identified and the genes sequenced to confirm their identity. The sequence designated ydlC (SEQ ID NO: 1) was the parent sequence utilized as the starting point for all experiments and library construction of engineered ketoreductases evolved from the *S. cerevisiae* ketoreductase.

The engineered ketoreductases can be obtained by subjecting the polynucleotide encoding the naturally occurring ketoreductase to mutagenesis and/or directed evolution methods. An exemplary directed evolution technique is mutagenesis and/or DNA shuffling as described in Stemmer, 1994, *Proc Natl Acad Sci USA* 91:10747-10751; WO 95/22625; WO 97/0078; WO 97/35966; WO 98/27230; WO 00/42651; WO 01/75767 and U.S. Pat. No. 6,537,746. Other directed evolution procedures that can be used include, among others, staggered extension process (StEP), in vitro recombination (Zhao et al., 1998, *Nat. Biotechnol.* 16:258-261), mutagenic PCR (Caldwell et al., 1994, *PCR Methods Appl.* 3:S136-S140), and cassette mutagenesis (Black et al., 1996, *Proc Natl Acad Sci USA* 93:3525-3529).

The clones obtained following mutagenesis treatment are screened for engineered ketoreductases having a desired improved enzyme property. Measuring enzyme activity from the expression libraries can be performed using the standard biochemistry technique of monitoring the rate of decrease (via a decrease in absorbance or fluorescence) of NADH or NADPH concentration, as it is converted into $NAD^+$ or $NADP^+$. In this reaction, the NADH or NADPH is consumed (oxidized) by the ketoreductase as the ketoreductase reduces a ketone substrate to the corresponding hydroxyl group. The rate of decrease of NADH or NADPH concentration, as measured by the decrease in absorbance or fluorescence, per unit time indicates the relative (enzymatic) activity of the KRED polypeptide in a fixed amount of the lysate (or a lyophilized powder made therefrom). Example 11 discloses an exemplary biochemical assay for ketoreductase activity. Where the improved enzyme property desired is thermal stability, enzyme activity may be measured after subjecting the enzyme preparations to a defined temperature and measuring the amount of enzyme activity remaining after heat treatments, such as in Example 12. Clones containing a polynucleotide encoding a ketoreductase are then isolated, sequenced to identify the nucleotide sequence changes (if any), and used to express the enzyme in a host cell.

Where the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides of the invention can be prepared by chemical synthesis using, e.g., the classical phosphoramidite method described by Beaucage et al., 1981, *Tet Lett* 22:1859-69, or the method described by Matthes et al., 1984, *EMBO J.* 3:801-05, e.g., as it is typically practiced in automated synthetic methods. According to the phosphoramidite method, oligonucleotides are synthesized, e.g., in an automatic DNA synthesizer, purified, annealed, ligated and cloned in appropriate vectors. In addition, essentially any nucleic acid can be obtained from any of a variety of commercial sources, such as The Midland Certified Reagent Company, Midland, Tex., The Great American Gene Company, Ramona, Calif., ExpressGen Inc. Chicago, Ill., Operon Technologies Inc., Alameda, Calif., and many others.

Engineered ketoreductase enzymes expressed in a host cell can be recovered from the cells and or the culture medium using any one or more of the well known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available under the trade name CelLytic B™ from Sigma-Aldrich of St. Louis Mo.

Chromatographic techniques for isolation of the ketoreductase polypeptide include, among others, reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., and will be apparent to those having skill in the art.

In some embodiments, affinity techniques may be used to isolate the improved ketoreductase enzymes. For affinity chromatography purification, any antibody which specifically binds the ketoreductase polypeptide may be used. For the production of antibodies, various host animals, including but not limited to rabbits, mice, rats, etc., may be immunized by injection with a compound. The compound may be attached to a suitable carrier, such as BSA, by means of a side chain functional group or linkers attached to a side chain functional group. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (bacilli Calmette Guerin) and *Corynebacterium parvum*.

An exemplary process for recovering the KRED polypeptides from cell lysate for applications in a chemical process is disclosed in Example 2.

7.6 Methods of Using the Engineered Ketoreductase Enzymes and Compounds Prepared Therewith The engineered ketoreductase enzymes described herein catalyze the reduction of 5-hydroxy-3-oxohexanoate enantiomers according to structural formula (Ia):

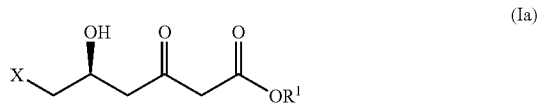

(Ia)

wherein X and $R^1$ are as previously defined, to yield the corresponding syn 3,5-dihydroxyhexanoate ester compound. As will be recognized by skilled artisans, the carbon at the 5-position of the compound of structural formula (I) is chiral. As a consequence, the compound can exist in two different enantiomeric forms: the enantiomer of structural formula (Ia) above and the enantiomer of structural formula (Ib):

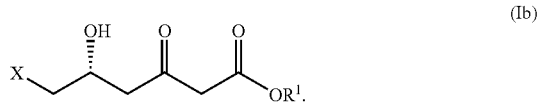

(Ib)

Skilled artisans will also recognize that when the oxo group at the 3-position is reduced to a hydroxy group, the carbon atom of the 3-position in the resultant 3,5-dihydroxy ester is also chiral. Thus, each of the enantiomers of structural formulae (Ia) and (Ib) can yield two different reduction products: a syn diastereomer and anti diastereomer. The syn and anti diastereomers produced by reduction of enantiomer (Ia) are illustrated below as compounds (IIa) and (IIb), respectively, and those produced by reduction of enantiomer (Ib) are illustrated as compounds (IIc) and (IId), respectively:

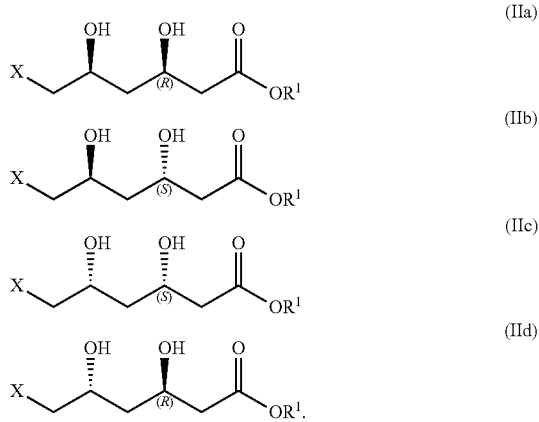

The absolute configurations about the 3-carbon are illustrated in the above structural diagrams. The R— or S— designations for the absolute configurations about the 5-carbon will depend upon the identity of the X. When X is cyano, the 5-carbon is designated R— in structures (Ia), (IIa) and (IIb) and designated S— in structures (Ib), (IIc) and (IId). When X is halo or hydroxy, the 5-carbon is designated S— in structures (Ia), (IIa) and (IIb) and designated R— in structures (Ib), (IIc) and (IId). This is due to the conventions for designating R or S, which reverse between X=cyano and X=halo or hydroxyl.

In some embodiments, the substrate (Ia) is of high enantiopurity, substantially free of (Ib).

In some embodiments, the reduction reaction is also highly diastereoselective, producing the syn diastereomer of structural formula (IIa) in ≧99.95% diastereomeric purity, i.e. ≦0.05% of the anti diastereomer of structural formula (IIb) (i.e., ≧.99.9% diastereomeric excess). Many embodiments of the engineered ketoreductases described herein exhibit even higher stereoselectivities. For example, in reactions of t-butyl 6-cyano-(5R)-hydroxy-3-oxohexanoate (structural formula (Ia), X═CN, $R^1$=t-butyl) carried out with the engineered ketoreductases referenced in Table 2, diastereoselectivities for 6-cyano-(3R,5R)-dihydroxyhexanoate (structural formula (IIa), X═CN, $R^1$=t-butyl) of ≧99.99% have been observed. Thus, diastereoselective reductions ranging from ≧99.9%, ≧99.91%, ≧99.92%, ≧99.93%, ≧99.94%, ≧99.95%, ≧99.96%, ≧99.97%, ≧99.98% and even ≧99.99% diastereoselectivity can be readily achieved with the engineered ketoreductase enzymes described herein.

The high degree of diastereoselectivity observed in reduction reactions catalyzed by the engineered ketoreductases described herein enables the ability to produce preparations of the syn 3,5-dihydroxyhexanoate ester of structural formula (IIa) that are substantially diastereomerically pure, i.e., that are substantially free of all other diastereomers, without having to perform chiral isolation or separation steps. Because the reaction can be performed in high yield, utilizing highly enantiopure 5-hydroxy-3-oxohexanoate ester (Ia) starting materials, the present disclosure enables the preparation of syn 3,5-dihydroxyhexanoate esters of structural formula (IIa) that are substantially diastereomerically pure with minimal or no purification. In contrast to the present disclosure, prior reduction methods (e.g., U.S. Pat. No. 6,596,879) produced 3-4% (IIb) (X═CN, $R^1$=t-butyl), which is an oil, and which was then reacted to form ((t-butyl 6-cyanomethyl-2,2-dimethyl-1,3-dioxane-4-acetate) (X═CN, $R^1$=t-butyl, $R^3,R^4$=methyl), a crystalline compound. In the prior known methods, the purity was improved by crystallization to lower the (IIb) content, which resulted in yield losses of (IIa).

The high degree of diastereomeric purity of the reduction products obtained with the engineered ketoreductase enzymes described herein is illustrated in FIG. 6, which compares the LC/MS/MS chromatogram of tert-butyl 6-cyanoethyl-(3R,5R)-dihydroxyhexanoate (structural formula (IIa), X═CN, $R^1$=t-butyl) prepared from commercially available crystalline t-butyl (6R)-cyanomethyl-2,2-dimethyl-1,3-dioxane-(4R)-acetate (structural formula (IVa), X═CN, $R^1$=t-butyl, $R^3,R^4$=methyl) (Aldrich, St. Louis, Mo.) with that of crude tert-butyl 6-cyano-(3R,5R)-dihydroxyhexanoate oil prepared from t-butyl 6-cyano-(5R)-hydroxy-3-oxohexanoate (structural formula (Ia), X═CN, $R^1$=t-butyl) using an engineered ketoreductase enzyme of the present disclosure. As illustrated in FIG. 6, compared to a tert-butyl (6R)-cyanoethyl-3,5-dihydroxyhexanoate sample prepared from commercially available crystalline t-butyl (6R)-cyanomethyl-2,2-dimethyl-1,3-dioxane-(4R)-acetate containing less than about 0.1% of the undesired (3S,5R) diastereomer (IIb), the crude tert-butyl 6-cyano-(3R,5R)-dihydroxyhexanoate oil prepared using the engineered ketoreductase of the disclosure contains no more than possibly 0.005% of the undesired (3S,5R) diastereomer.

Similarly striking differences in diastereomeric purity are observed for t-butyl (6R)-cyanomethyl-2,2-dimethyl-1,3-dioxane-(4R)-acetate (see Example 23 and FIG. 7). GC/MS chromatograms comparing the stereoisomeric purity of the commercially available crystalline TBIN ((4R,cis)-1,1-dimethyl-6-cyanomethyl-2,2-dimethyl-1,3-dioxane-4-acetate)) and crude, extracted, but never crystallized TBIN prepared from crude C7 diol prepared using an engineered ketoreductase enzyme of the present invention are illustrated in FIG. 7. Likewise, the diastereomeric purity of atorvastatin produced from C7 diol prepared using the methods of the present disclosure are greater than what is currently present in commercial preparations (e.g., 0.03% atorvastatin diastereomer present in a Lipitor® pill).

As used herein, a compound is "enriched" in a particular stereoisomer when that stereoisomer is present in excess over any other stereoisomer present in the compound. A compound that is enriched in a particular stereoisomer will typically comprise at least about 60%, 70%, 80%, 90%, or even more, of the specified stereoisomer. The amount of enrichment of a particular stereoisomer can be confirmed using conventional analytical methods routinely used by those of skill in the art, as will be discussed in more detail, below.

In some embodiments, the amount of undesired stereoisomers may be less than 10%, for example, less than 9%, less than 8%, less than 7%, less than 6%, less than 5%, less than 4%, less than 3%, less than 2%, less than 1% or even less than 0.9%, 0.8%, 0.7%, 0.6%, 0.5%, 0.4%, 0.2%, or 0.1%. Stereoisomerically enriched compounds that contain at least about 99.5% or more of the desired stereoisomer are referred to herein as "substantially pure" stereoisomers. In some embodiments, compounds that are substantially pure in a specified stereoisomer contain greater than 99.6%, 99.7%, 99.8%, 99.9%, 99.91%, 99.92%, 99.93%, 99.94%, 99.95%, 99.96%, 99.97%, 99.98% or even 99.99% of the particular stereoisomer. Stereoisomerically enriched compounds that contain ≧99.99% of the desired stereoisomer are referred to herein as "pure" stereoisomers.

The stereoisomeric purity of any chiral compound described herein can be determined or confirmed using conventional analytical methods known in the art. Highly sensitive LC/MS and GC/MS methods and for assessing diastereoisomeric purity of the synthetic intermediates described herein are provided in Examples 5-7. A method for determining diastereomeric purity of atorvastatin is given in Ertürk et al., 2003, *J Pharm Biomed Anal*. 33(5):1017-23.

As is known by those of skill in the art, ketoreductase-catalyzed reduction reactions typically require a cofactor. Reduction reactions catalyzed by the engineered ketoreductase enzymes described herein also typically require a cofactor, although many embodiments of the engineered ketoreductases require far less cofactor than reactions catalyzed with wild-type ketoreductase enzymes. As used herein, the term "cofactor" refers to a non-protein compound that operates in combination with a ketoreductase enzyme. Cofactors suitable for use with the engineered ketoreductase enzymes described herein include, but are not limited to, NADP$^+$ (nicotinamide adenine dinucleotide phosphate), NADPH (the reduced form of NADP$^+$), NAD$^+$ (nicotinamide adenine dinucleotide) and NADH (the reduced form of NAD$^+$). Equation (1), below, illustrates an embodiment of a ketoreductase ("KRED")-catalyzed reduction reaction utilizing NADH or NADPH as a cofactor, which are represented as alternatives by the designation NAD(P)H:

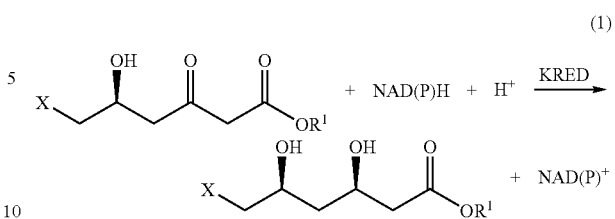

As illustrated, the reduced form of the cofactor is added to the reaction mixture. The reduced NAD(P)H form can be optionally regenerated from the oxidized NAD(P)$^+$ form using a cofactor regeneration system.

The term "cofactor regeneration system" refers to a set of reactants that participate in a reaction that reduces the oxidized form of the cofactor (e.g., NADP$^+$ to NADPH). Cofactors oxidized by the ketoreductase-catalyzed reduction of the 5-hydroxy-3-oxo-hexanoate ester are regenerated in reduced form by the cofactor regeneration system. Cofactor regeneration systems comprise a stoichiometric reductant that is a source of reducing hydrogen equivalents and is capable of reducing the oxidized form of the cofactor. The cofactor regeneration system may further comprise a catalyst, for example an enzyme catalyst, that catalyzes the reduction of the oxidized form of the cofactor by the reductant. Cofactor regeneration systems to regenerate NADH or NADPH from NAD$^+$ or NADP$^+$, respectively, are known in the art and may be used in the methods described herein.

Suitable exemplary cofactor regeneration systems that may be employed include, but are not limited to, glucose and glucose dehydrogenase, formate and formate dehydrogenase, glucose-6-phosphate and glucose-6-phosphate dehydrogenase, a secondary (e.g., isopropanol) alcohol and secondary alcohol dehydrogenase, phosphite and phosphite dehydrogenase, molecular hydrogen and hydrogenase, and the like. These systems may be used in combination with either NADP$^+$/NADPH or NAD$^+$/NADH as the cofactor. Electrochemical regeneration using hydrogenase may also be used as a cofactor regeneration system. See, e.g., U.S. Pat. Nos. 5,538,867 and 6,495,023, both of which are incorporated herein by reference. Chemical cofactor regeneration systems comprising a metal catalyst and a reducing agent (for example, molecular hydrogen or formate) are also suitable. See, e.g., PCT publication WO 2000/053731, which is incorporated herein by reference.

The terms "glucose dehydrogenase" and "GDH" are used interchangeably herein to refer to an NAD$^+$ or NADP$^+$-dependent enzyme that catalyzes the conversion of D-glucose and NAD$^+$ or NADP$^+$ to gluconic acid and NADH or NADPH, respectively. Equation (2), below, describes the glucose dehydrogenase-catalyzed reduction of NAD$^+$ or NADP$^+$ by glucose.

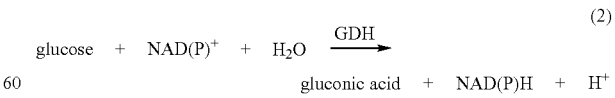

Glucose dehydrogenases that are suitable for use in the practice of the methods described herein include both naturally occurring glucose dehydrogenases, as well as non-naturally occurring glucose dehydrogenases. Naturally occurring glucose dehydrogenase encoding genes have been reported in the literature. For example, the *Bacillus subtilis* 61297 GDH gene was expressed in *E. coli* and was reported to exhibit the same physicochemical properties as the enzyme produced in its native host (Vasantha et al., 1983, *Proc. Natl. Acad. Sci. USA* 80:785). The gene sequence of the *B. subtilis* GDH gene, which corresponds to Genbank Acc. No. M12276, was reported by Lampel et al., 1986, *J. Bacteriol.* 166:238-243, and in corrected form by Yamane et al., 1996, *Microbiology* 142:3047-3056 as Genbank Acc. No. D50453. Naturally occurring GDH genes also include those that encode the GDH from *B. cereus* ATCC 14579 (*Nature*, 2003, 423:87-91; Genbank Acc. No. AE017013) and *B. megaterium* (*Eur. J. Biochem.*, 1988, 174:485-490, Genbank Acc. No. X12370; *J. Ferment. Bioeng.*, 1990, 70:363-369, Genbank Acc. No. GI216270). Glucose dehydrogenases from *Bacillus* sp. are provided in PCT publication WO 2005/018579 as SEQ ID NOS: 10 and 12 (encoded by polynucleotide sequences corresponding to SEQ ID NOS: 9 and 11, respectively, of the PCT publication), the disclosure of which is incorporated herein by reference.

Non-naturally occurring glucose dehydrogenases may be generated using known methods, such as, for example, mutagenesis, directed evolution, and the like. GDH enzymes having suitable activity, whether naturally occurring or non-naturally occurring, may be readily identified using the assay described in Example 4 of PCT publication WO 2005/018579, the disclosure of which is incorporated herein by reference. Exemplary non-naturally occurring glucose dehydrogenases are provided in PCT publication WO 2005/018579 as SEQ ID NOS: 62, 64, 66, 68, 122, 124, and 126. The polynucleotide sequences that encode them are provided in PCT publication WO 2005/018579 as SEQ ID NOS: 61, 63, 65, 67, 121, 123, and 125, respectively. All of these sequences are incorporated herein by reference. Additional non-naturally occurring glucose dehydrogenases that are suitable for use in the ketoreductase-catalyzed reduction reactions disclosed herein are provided in U.S. application publication Nos. 2005/0095619 and 2005/0153417, the disclosures of which are incorporated herein by reference.

Glucose dehydrogenases employed in the ketoreductase-catalyzed reduction reactions described herein may exhibit an activity of at least about 10 µmol/min/mg and sometimes at least about $10^2$ µmol/min/mg or about $10^3$ µmol/min/mg, up to about $10^4$ µmol/min/mg or higher in the assay described in Example 4 of PCT publication WO 2005/018579.

When glucose and glucose dehydrogenase are employed as the cofactor regeneration system, as the 5-hydroxy-3-oxohexanoate ester substrate is reduced by the engineered ketoreductase and NADH or NADPH, the resulting $NAD^+$ or $NADP^+$ is reduced by the coupled oxidation of glucose to gluconic acid by the glucose dehydrogenase. The net reaction is described by equation (3), which is the summation of equations (1) and (2):

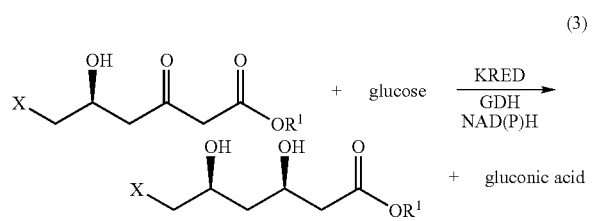

(3)

The ketoreductase-catalyzed reduction reactions described herein are generally carried out in a solvent. Suitable solvents include water, organic solvents (e.g., ethyl acetate, butyl acetate, 1-octanol, heptane, octane, methyl t-butyl ether (MTBE), toluene, and the like), ionic liquids (e.g., 1-ethyl 4-methylimidazolium tetrafluoroborate, 1-butyl-3-methylimidazolium tetrafluoroborate, 1-butyl-3-methylimidazolium hexafluorophosphate, and the like). In some embodiments, aqueous solvents, including water and aqueous co-solvent systems, are used.

Exemplary aqueous co-solvent systems have water and one or more organic solvent. In general, an organic solvent component of an aqueous co-solvent system is selected such that it does not completely inactivate the ketoreductase enzyme. Appropriate co-solvent systems can be readily identified by measuring the enzymatic activity of the specified engineered ketoreductase enzyme with the 5-hydroxy-3-oxohexanoate ester of interest in the candidate solvent system, utilizing an enzyme activity assay, such as those described in the Examples.

The organic solvent component of an aqueous co-solvent system may be miscible with the aqueous component, providing a single liquid phase, or may be partly miscible or immiscible with the aqueous component, providing two liquid phases. Generally, when an aqueous co-solvent system is employed, it is selected to be biphasic, with water dispersed in an organic solvent, or vice-versa. Generally, when an aqueous co-solvent system is utilized, it is desirable to select an organic solvent that can be readily separated from the aqueous phase. In general, the ratio of water to organic solvent in the co-solvent system is typically in the range of from about 90:10 to about 10:90 (v/v) organic solvent to water, and between 80:20 and 20:80 (v/v) organic solvent to water. The co-solvent system may be pre-formed prior to addition to the reaction mixture, or it may be formed in situ in the reaction vessel.

The aqueous solvent (water or aqueous co-solvent system) may be pH-buffered or unbuffered. The reduction of the 5-hydroxy-3-oxohexanoate ester to the corresponding 3,5-dihydroxyhexanoate ester can be carried out at a pH of about 5 or above. Generally, the reduction is carried out at a pH of about 10 or below, usually in the range of from about 5 to about 10. In some embodiments, the reduction is carried out at a pH of about 9 or below, usually in the range of from about 5 to about 9. In some embodiments, the reduction is carried out at a pH of about 8 or below, often in the range of from about 5 to about 8, and usually in the range of from about 6 to about 8. The reduction may also be carried out at a pH of about 7.8 or below, or 7.5 or below. Alternatively, the reduction may be carried out a neutral pH, i.e., about 7.

During the course of the reduction reactions, the pH of the reaction mixture may change. The pH of the reaction mixture may be maintained at a desired pH or within a desired pH range by the addition of an acid or a base during the course of the reaction. Alternatively, the pH may be controlled by using an aqueous solvent that comprises a buffer. Suitable buffers to maintain desired pH ranges are known in the art and include, for example, phosphate buffer, triethanolamine buffer, and the like. Combinations of buffering and acid or base addition may also be used.

When the glucose/glucose dehydrogenase cofactor regeneration system is employed, the co-production of gluconic acid (pKa=3.6), as represented in equation (3) causes the pH of the reaction mixture to drop if the resulting aqueous gluconic acid is not otherwise neutralized. The pH of the reaction mixture may be maintained at the desired level by standard buffering techniques, wherein the buffer neutralizes the gluconic acid up to the buffering capacity provided, or by the addition of a base concurrent with the course of the conversion. Combinations of buffering and base addition may also be used. Suitable buffers to maintain desired pH ranges are described above. Suitable bases for neutralization of gluconic acid are organic bases, for example amines, alkoxides and the like, and inorganic bases, for example, hydroxide salts (e.g., NaOH), carbonate salts (e.g., $K_2CO_3$), bicarbonate salts (e.g., $NaHCO_3$), basic phosphate salts (e.g., $K_2HPO_4$, $Na_3PO_4$), and the like. The addition of a base concurrent with the course of the conversion may be done manually while monitoring the reaction mixture pH or, more conveniently, by using an automatic titrator as a pH stat. A combination of partial buffering capacity and base addition can also be used for process control.

In such reduction reactions when the pH is maintained by buffering or by addition of a base over the course of the conversion, an aqueous gluconate salt rather than aqueous gluconic acid is the product of the overall process. For example, equation (4) represents the overall process when aqueous sodium hydroxide ($Na^+ + OH^-$) is added over the course of the reaction to maintain an initial pH below about 5 or above.

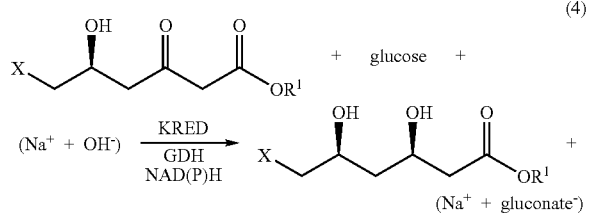

(4)

When base addition is employed to neutralize the gluconic acid released during the ketoreductase-catalyzed reduction reaction, the progress of the conversion may be monitored by the amount of base added to maintain the pH. Typically, bases added to unbuffered or partially buffered reaction mixtures over the course of the reduction are added in aqueous solutions.

In some embodiments, when the process is carried out using whole cells of the host organism, the whole cell may natively provide the cofactor. Alternatively or in combination, the cell may natively or recombinantly provide the glucose dehydrogenase.

The terms "formate dehydrogenase" and "FDH" are used interchangeably herein to refer to an $NAD^+$ or $NADP^+$-dependent enzyme that catalyzes the conversion of formate and $NAD^+$ or $NADP^+$ to carbon dioxide and NADH or NADPH, respectively. Formate dehydrogenases that are suitable for use as cofactor regenerating systems in the ketoreductase-catalyzed reduction reactions described herein include both naturally occurring formate dehydrogenases, as well as non-naturally occurring formate dehydrogenases. Formate dehydrogenases include those corresponding to SEQ ID NOS: 70 (*Pseudomonas* sp.) and 72 (*Candida boidinii*) of PCT publication WO 2005/018579, which are encoded by polynucleotide sequences corresponding to SEQ ID NOS: 69 and 71, respectively, of PCT publication 2005/018579, the disclosures of which are incorporated herein by reference. Formate dehydrogenases employed in the methods described herein, whether naturally occurring or non-naturally occurring, may exhibit an activity of at least about 1 μmol/min/mg, sometimes at least about 10 μmol/min/mg, or at least about $10^2$ μmol/min/mg, up to about $10^3$ μmol/min/mg or higher, and can be readily screened for activity in the assay described in Example 4 of PCT publication WO 2005/018579.

As used herein, the term "formate" refers to formate anion ($HCO_2^-$), formic acid ($HCO_2H$), and mixtures thereof. Formate may be provided in the form of a salt, typically an alkali or ammonium salt (for example, $HCO_2Na$, $KHCO_2NH_4$, and the like), in the form of formic acid, typically aqueous formic acid, or mixtures thereof. Formic acid is a moderate acid. In aqueous solutions within several pH units of its pKa (pKa=3.7 in water) formate is present as both $HCO_2^-$ and $HCO_2H$ in equilibrium concentrations. At pH values above about pH 4, formate is predominantly present as $HCO_2^-$. When formate is provided as formic acid, the reaction mixture is typically buffered or made less acidic by adding a base to provide the desired pH, typically of about pH 5 or above. Suitable bases for neutralization of formic acid include, but are not limited to, organic bases, for example amines, alkoxides and the like, and inorganic bases, for example, hydroxide salts (e.g., NaOH), carbonate salts (e.g., $K_2CO_3$), bicarbonate salts (e.g., $NaHCO_3$), basic phosphate salts (e.g., $K_2HPO_4$, $Na_3PO_4$), and the like.

For pH values above about pH 5, at which formate is predominantly present as $HCO_2^-$, equation (5), below, describes the formate dehydrogenase-catalyzed reduction of $NAD^+$ or $NADP^+$ by formate.

(5)

When formate and formate dehydrogenase are employed as the cofactor regeneration system, the 5-hydroxy-3-oxohexanoate ester is reduced by the ketoreductase and NADH or NADPH, the resulting $NAD^+$ or $NADP^+$ is reduced by the coupled oxidation of formate to carbon dioxide by the formate dehydrogenase. An embodiment of the net reaction is described by equation (6), which is the summation of equations (1) and (5):

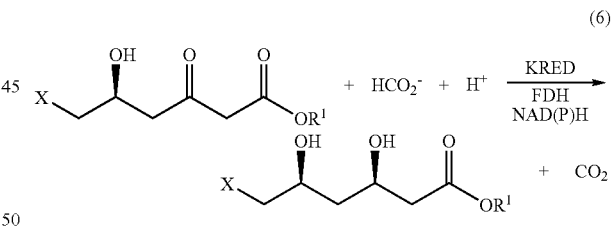

(6)

Equation (6) shows that when the formate/formate dehydrogenase cofactor regeneration system is employed for the reduction of 5-hydroxy-3-oxohexanoate ester in aqueous solution at a pH above about pH 5, protons in solution are consumed and the reaction causes the pH of the reaction mixture to rise if it is not otherwise buffered or re-acidified. The pH of the reaction mixture may be maintained at the desired level by standard buffering techniques, wherein the buffer releases protons up to the buffering capacity provided, or by the addition of an acid concurrent with the course of the conversion. Suitable acids to add during the course of the reaction to maintain the pH include organic acids, for example carboxylic acids, sulfonic acids, phosphonic acids, and the like, mineral acids, for example hydrohalic acids (such as hydrochloric acid), sulfuric acid, phosphoric acid, and the like, acidic salts, for example dihydrogenphosphate salts (e.g., KH$_2$PO$_4$), bisulfate salts (e.g., NaHSO$_4$) and the like. Some embodiments utilize formic acid, whereby both the formate concentration and the pH of the solution are maintained. For example, equation (7) represents the overall process when formic acid (HCO$_2$H) is added over the course of the reaction to maintain an initial pH above about pH 5. While the formate is present predominantly as HCO$_2^-$ in the reaction mixture, the HCO$_2^-$ concentration is maintained while the conversion in net consumes the added formic acid.

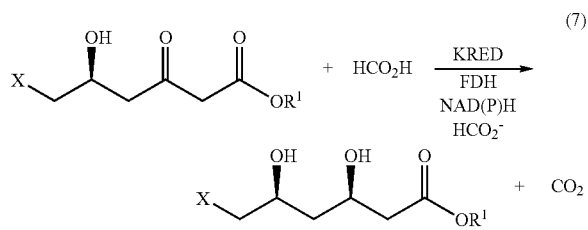

(7)

When acid addition is employed to maintain the pH during a reduction reaction using the formate/formate dehydrogenase cofactor regeneration system, the progress of the conversion may be monitored by the amount of acid added to maintain the pH. Typically, acids added to unbuffered or partially buffered reaction mixtures over the course of conversion are added in aqueous solutions.

The terms "secondary alcohol dehydrogenase" and "sADH" are used interchangeably herein to refer to an NAD$^+$ or NADP$^+$-dependent enzyme that catalyzes the conversion of a secondary alcohol and NAD$^+$ or NADP$^+$ to a ketone and NADH or NADPH, respectively. Equation (8), below, describes the reduction of NAD$^+$ or NADP$^+$ by a secondary alcohol, illustrated by isopropanol.

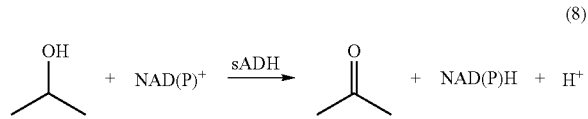

(8)

Secondary alcohol dehydrogenases that are suitable for use as cofactor regenerating systems in the ketoreductase-catalyzed reduction reactions described herein include both naturally occurring secondary alcohol dehydrogenases, as well as non-naturally occurring secondary alcohol dehydrogenases. Naturally occurring secondary alcohol dehydrogenases include known alcohol dehydrogenases from, *Thermoanaerobium brockii, Rhodococcus erythropolis, Lactobacillus kefiri*, and *Lactobacillus brevis*, and non-naturally occurring secondary alcohol dehydrogenases include engineered alcohol dehydrogenases derived therefrom. Secondary alcohol dehydrogenases employed in the methods described herein, whether naturally occurring or non-naturally occurring, may exhibit an activity of at least about 1 µmol/min/mg, sometimes at least about 10 µmol/min/mg, or at least about 10$^2$ µmol/min/mg, up to about 10$^3$ µmol/min/mg or higher.

Suitable secondary alcohols include lower secondary alkanols and aryl-alkyl carbinols. Examples of lower secondary alcohols include isopropanol, 2-butanol, 3-methyl-2-butanol, 2-pentanol, 3-pentanol, 3,3-dimethyl-2-butanol, and the like. In one embodiment the secondary alcohol is isopropanol. Suitable aryl-alkyl carbinols include unsubstituted and substituted 1-arylethanols.

When a secondary alcohol and secondary alcohol dehydrogenase are employed as the cofactor regeneration system, as the 5-hydroxy-3-oxohexanoate ester substrate is reduced by the engineered ketoreductase and NADH or NADPH, the resulting NAD$^+$ or NADP$^+$ is reduced by the coupled oxidation of the secondary alcohol to the ketone by the secondary alcohol dehydrogenase. The net reaction is described by equation (9), illustrated with isopropanol, which is the summation of equations (1) and (8):

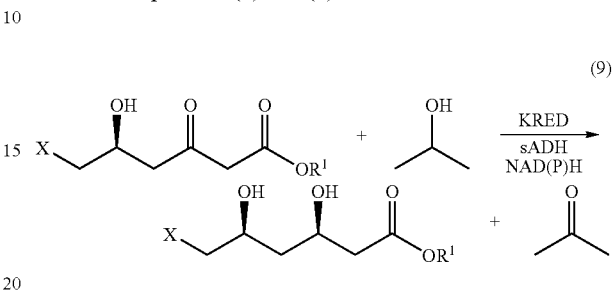

(9)

It will be appreciated by the skilled artisan this reaction of a ketone and alcohol to the corresponding alcohol and ketone, respectively, is reversible, and will reach an equilibrium. The inventors found that the forward reaction is thermodynamically favored, and that only a modest excess of isopropanol is required to obtain high conversion of the 3-oxohexanoate ester to the desired 3,5-dihydroxyhexanoate ester at the equilibrium. Typically, the molar ratio of the secondary alcohol to the 3-oxohexanoate ester provided to the reaction is in the range of 1 to 20. In some embodiments this molar ratio is 1 to 10, 1 to 5, or 1 to 2.

Some engineered ketoreductases also have activity to dehydrogenate a secondary alcohol reductant. In some embodiments using secondary alcohol as reductant, the engineered ketoreductase and the secondary alcohol dehydrogenase are the same enzyme.

In carrying out embodiments of the ketoreductase-catalyzed reduction reactions described herein employing a cofactor regeneration system, either the oxidized or reduced form of the cofactor may be provided initially. As described above, the cofactor regeneration system converts oxidized cofactor to its reduced form, which is then utilized in the reduction of the ketoreductase substrate (i.e., 5-hydroxy-3-oxohexanoate ester) to the corresponding 3,5-dihydroxyhexanoate ester.

In some embodiments, cofactor regeneration systems are not used. For reduction reactions carried out without the use of a cofactor regenerating systems, the cofactor is added to the reaction mixture in reduced form.

In carrying out the enantioselective reduction reactions described herein, the engineered ketoreductase enzyme, and any enzymes comprising the optional cofactor regeneration system, may be added to the reaction mixture in the form of the purified enzymes, whole cells transformed with gene(s) encoding the enzymes, and/or cell extracts and/or lysates of such cells. The gene(s) encoding the engineered ketoreductase enzyme and the optional cofactor regeneration enzymes can be transformed into host cells separately or together into the same host cell. For example, in some embodiments one set of host cells can be transformed with gene(s) encoding the engineered ketoreductase enzyme and another set can be transformed with gene(s) encoding the cofactor regeneration enzymes. Both sets of transformed cells can be utilized together in the reaction mixture in the form of whole cells, or in the form of lysates or extracts derived therefrom. In other embodiments, a host cell can be transformed with gene(s)

encoding both the engineered ketoreductase enzyme and the cofactor regeneration enzymes.

Whole cells transformed with gene(s) encoding the engineered ketoreductase enzyme and/or the optional cofactor regeneration enzymes, or cell extracts and/or lysates thereof, may be employed in a variety of different forms, including solid (e.g., lyophilized, spray-dried, and the like) or semisolid (e.g., a crude paste).

The cell extracts or cell lysates may be partially purified by precipitation (ammonium sulfate, polyethyleneimine, heat treatment or the like, followed by a desalting procedure prior to lyophilization (e.g., ultrafiltration, dialysis, and the like). Any of the cell preparations may be stabilized by crosslinking using known crosslinking agents, such as, for example, glutaraldehyde or immobilization to a solid phase (e.g., Eupergit C, and the like).

The solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a prechilled lyophilization chamber, followed by the application of a vacuum. After the removal of water from the samples, the temperature is typically raised to 4° C. for two hours before release of the vacuum and retrieval of the lyophilized samples.

The quantities of reactants used in the reduction reaction will generally vary depending on the quantities of 3,5-dihydroxyhexanoate ester desired, and concomitantly the amount of ketoreductase substrate employed. The following guidelines can be used to determine the amounts of ketoreductase, cofactor, and optional cofactor regeneration system to use. Generally, 5-hydroxy-3-oxo-hexanoate ester substrates are employed at a concentration of about 20 to 300 grams/liter using from about 50 mg to about 5 g of ketoreductase and about 10 mg to about 150 mg of cofactor. Those having ordinary skill in the art will readily understand how to vary these quantities to tailor them to the desired level of productivity and scale of production. Appropriate quantities of optional cofactor regeneration system may be readily determined by routine experimentation based on the amount of cofactor and/or ketoreductase utilized. In general, the reductant (e.g., glucose, formate, isopropanol) is utilized at levels above the equimolar level of ketoreductase substrate to achieve essentially complete or near complete conversion of the ketoreductase substrate.

The order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor regeneration system, cofactor, ketoreductase, and ketoreductase substrate may be added first to the solvent.

For improved mixing efficiency when an aqueous co-solvent system is used, the cofactor regeneration system, ketoreductase, and cofactor may be added and mixed into the aqueous phase first. The organic phase may then be added and mixed in, followed by addition of the ketoreductase substrate. Alternatively, the ketoreductase substrate may be premixed in the organic phase, prior to addition to the aqueous phase Suitable conditions for carrying out the ketoreductase-catalyzed reduction reactions described herein include a wide variety of conditions which can be readily optimized by routine experimentation that includes, but is not limited to, contacting the engineered ketoreductase enzyme and substrate at an experimental pH and temperature and detecting product, for example, using the methods described in the Examples provided herein.

The ketoreductase catalyzed reduction is typically carried out at a temperature in the range of from about 15° C. to about 75° C. For some embodiments, the reaction is carried out at a temperature in the range of from about 20° C. to about 55° C. In still other embodiments, it is carried out at a temperature in the range of from about 20° C. to about 45° C. The reaction may also be carried out under ambient conditions.

The reduction reaction is generally allowed to proceed until essentially complete, or near complete, reduction of substrate is obtained. Reduction of substrate to product can be monitored using known methods by detecting substrate and/or product. Suitable methods include gas chromatography, HPLC, and the like. Conversion yields of the 3,5-dihydroxyhexanoate ester reduction product generated in the reaction mixture are generally greater than about 50%, may also be greater than about 60%, may also be greater than about 70%, may also be greater than about 80%, may also be greater than 90%, and are often greater than about 97%.

The 3,5-dihydroxyhexanoate reduction product can be recovered from the reaction mixture and optionally further purified using methods that are known to those of skill in the art. Suitable methods are described in U.S. Pat. Nos. 6,001,615, 6,472,544, 6,596,879, and 6,645,746, the disclosures of which are incorporated herein by reference. Additional suitable methods are provided in the Examples below.

As previously discussed, the ketoreductase-catalyzed reduction of the 5-hydroxy-3-oxohexanoate ester enantiomer (Ia) generates a new stereogenic carbon at the 3-position of the 3,5-dihydroxyhexanoate ester product. As also previously discussed, in reactions carried out with the engineered ketoreductase enzymes described herein, the reduction product is generated with a high degree of syn-stereoselectivity at the 3-position: Thus, the 3,5-dihydroxyhexanoate esters generated using the engineered ketoreductase enzymes described herein are chiral and non-racemic. As mentioned above, the ketoreductase reactions described herein typically generate chiral syn 3,5-dihydroxyhexanoate esters according to structural formula (IIa) having a diastereomeric purity of at least about 99.5%, usually at least about 99.9%, and typically at least about 99.95%. The Examples illustrate embodiments providing tert-butyl 6-cyano-(3R,5R)-dihydroxyhexanoate ester with a diastereomeric purity of $\geq 99.993\%$.

Certain of the substrates described herein have been found to be particularly useful in the synthesis of clinically important cholesterol-lowering statin drugs. Such compounds include those in which $R^1$ is a lower alkyl, in some embodiments, tert-butyl, and X is selected from chloro, cyano and hydroxyl and $OR^2$ is as defined herein. Thus, some embodiments of the compounds according to structural formulae (Ia), (IIa), (IIIa), (IVa) and (Va) described herein include those compounds in which $R^1$ is a lower alkyl or tert-butyl and/or X is selected from chloro, cyano and hydroxy.

In embodiments of the compounds according to structural formulae (Ia), (IIa), (IIIa), (IVa) and (Va) in which X is —$OR^6$, where $R^6$ is a protecting group, the group can be virtually any protecting group known to be useful for protecting hydroxyl groups during organic syntheses. The identity of the specific protecting group will depend upon the various synthetic reaction conditions, and can be readily selected for specific situation by those of skill in the art. Suitable exemplary protecting groups are described in Greene & Wuts, "Protective Groups in Organic Synthesis," $3^{rd}$ Ed., 1999, John Wiley & Sons, NY (see, for example, pp. 17-200). In some embodiments, the protecting group is selected from ether protection groups (e.g., benzyl, t-butyl, tetrahydropyranyl, methoxyethoxymethyl, methoxymethyl, etc.), silyl ether protection groups (e.g., trimethylsilyl, triethylsilyl, t-butyl-dimethylsilyl, triphenylsilyl, etc.), ester protection groups (e.g., benzoate, alkylate, haloalkylate, etc.), carbonate protecting groups (e.g., alkyl methyl, methoxymethyl, alkyl 2,2,2,-trichloroethyl, allyl allyl carbonate, alkyl benzyl, etc.), and sulfonate protecting groups (e.g., allylsulfonate, methanesulfonate, benzylsulfonate, tosylate, etc.).

Figure 1:
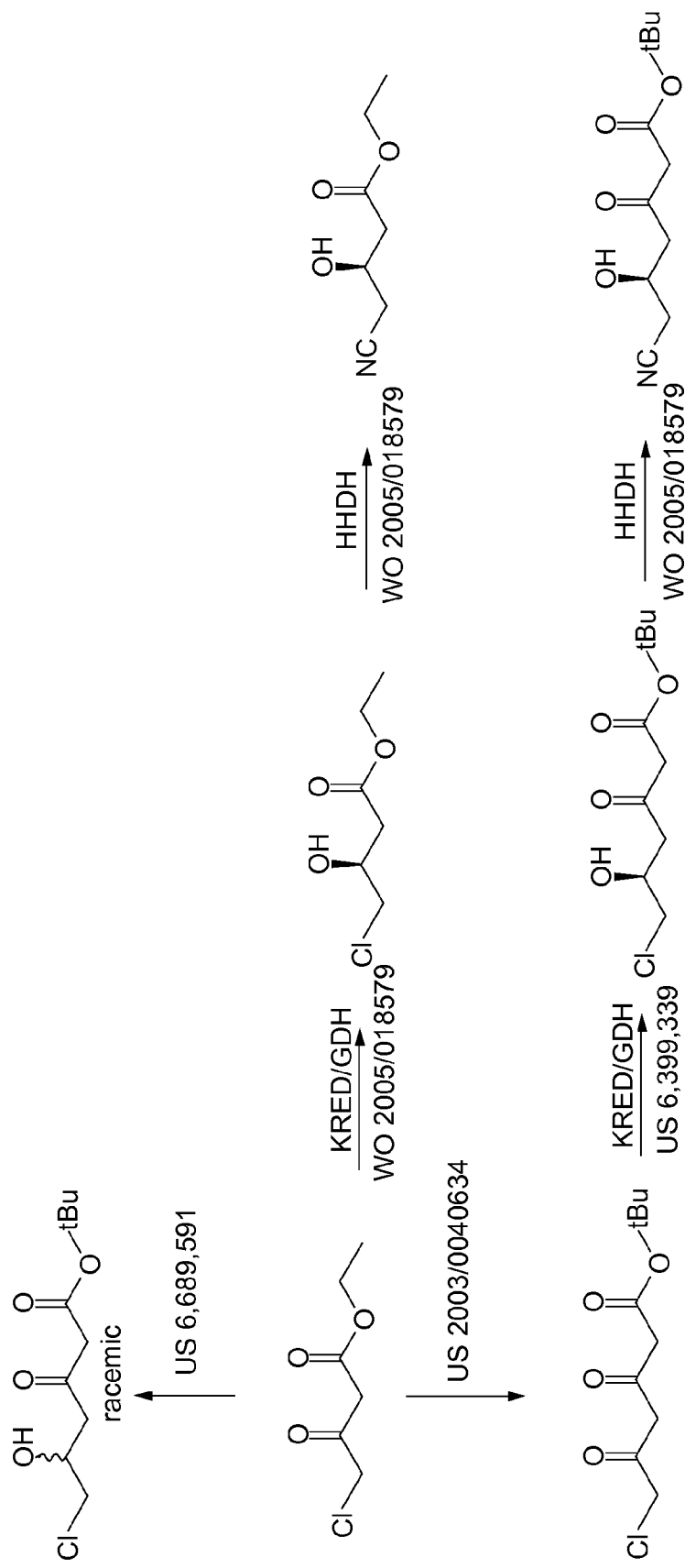
FIG. 1 illustrates the role of ketoreductases and halohydrin dehalogenases in converting an alkyl 4-halo-3-oxobutyrate to various intermediates useful in the synthesis of statins.

The 5-hydroxy-3-oxohexanoate ester enantiomers of structural formulae (Ia) can be prepared using standard methods that are well-known in the art. Suitable exemplary methods are described in U.S. Pat. No. 6,399,339 (for specific examples in which X=Cl and $R^1$=tert-butyl, see Example 1); U.S. Pat. No. 5,155,251 and the various references cited therein (X=CN, $R^1$=tert-butyl), Japanese Patent Publication No. 1723728 (X=Cl, $R^1$=tert-butyl) and PCT publication WO 2005/018579 (X=Cl or CN, $R^1$=tert-butyl), the disclosures of which are incorporated herein by reference. FIG. 1 provides a diagram illustrating exemplary methods for synthesizing the substrates in both enantiomerically pure form and as racemic mixtures (International Publication Nos. WO 2003/070733 and WO 2004/113314).

The syn 3,5-dihydroxyhexanoate esters produced by the engineered ketoreductase-catalyzed reduction reactions described herein can be used as starting materials to synthesize clinically important cholesterol-lowering statin drugs, such as atorvastatin, rosuvastatin, and pitavastatin. A key intermediate in the synthesis of these statins is the protected syn 3,5-dihydroxyhexanoate ester of structural formula (IIIa) or (IVa), supra. Methods for synthesizing such protected esters are well known. In embodiments in which the $R^2$ substituents in the compounds of structural formula (IIIa) represent unbridged protecting groups, the protecting groups can be selected from those described above. Compounds including these protecting groups can be synthesized as described, for example, in Greene & Wuts, "Protective Groups in Organic Synthesis," $3^{rd}$ Ed., 1999, John Wiley & Sons, NY (see, for example, pp. 17-200). The actual methods used will depend upon the identity of the protecting group(s).

Embodiments in which the $R^2$ groups are taken together to form an optionally substituted alkylene bridge can be synthesized from the syn 3,5-dihydroxyhexanoate esters using the methods described in U.S. Pat. No. 5,097,045 (X=cyano), U.S. Pat. No. 6,472,544 (X=halo or OH) and U.S. Pat. No. 6,344,569 (X=halo or CN), the disclosures of which are incorporated herein by reference. Compounds including these protecting groups can be synthesized as described, for example, in Greene & Wuts, "Protective Groups in Organic Synthesis," 3rd Ed., 1999, John Wiley & Sons, NY (see, for example, pp. 201-245).

As a specific example, compounds according to structural formula (IVa) in which X is cyano can be prepared by treating the corresponding (3R,5R)-6-cyano-3,5-dihydroxyhexanoate ester with an acetal forming reagent as described in U.S. Pat. No. 6,344,569, at Col. 7, line 30 through Col. 8, line 40, the disclosure of which is incorporated herein by reference.

As another specific example, compounds according to structural formula (IVa) in which X is halo can be prepared by treating the corresponding (3R,5S)-6-halo-3,5-dihydroxyhexanoate ester with an acetal forming reagent as described in U.S. Pat. No. 6,344,569 at Col. 9, line 21 through Col. 10, line 34, the disclosure of which is incorporated herein by reference.

As yet another specific example, compounds according to structural formula (IVa) in which X is cyano can be prepared by treating the chloro analog (prepared as described above), with a cyanating reagent as described in U.S. Pat. No. 6,344,569 at Col. 11, line 17 through Col. 12, line 5, the disclosure of which is incorporated herein by reference.

In some embodiments, the $R^2$ groups of the protected syn 3,5-dihydroxyhexanoate taken together can form a cyclic boronate protecting group of —$BR^5$—, wherein the $R^5$ is selected from (C1-C12) alkyl, (C6-C10) aryl and (C7-C12) arylalkyl. In a specific embodiment, $R^5$ is phenyl. Compounds with cyclic boronate based protecting groups can be synthesized as described, for example, in Greene & Wuts, "Protective Groups in Organic Synthesis," 3rd Ed., 1999, John Wiley & Sons, NY (see, for example, pp. 243-245). An exemplary phenyl boronate protected syn 3,5-dihydroxyhexanoate ester is described in U.S. Pat. No. 6,867,306, incorporated herein by reference.

Figure 2:
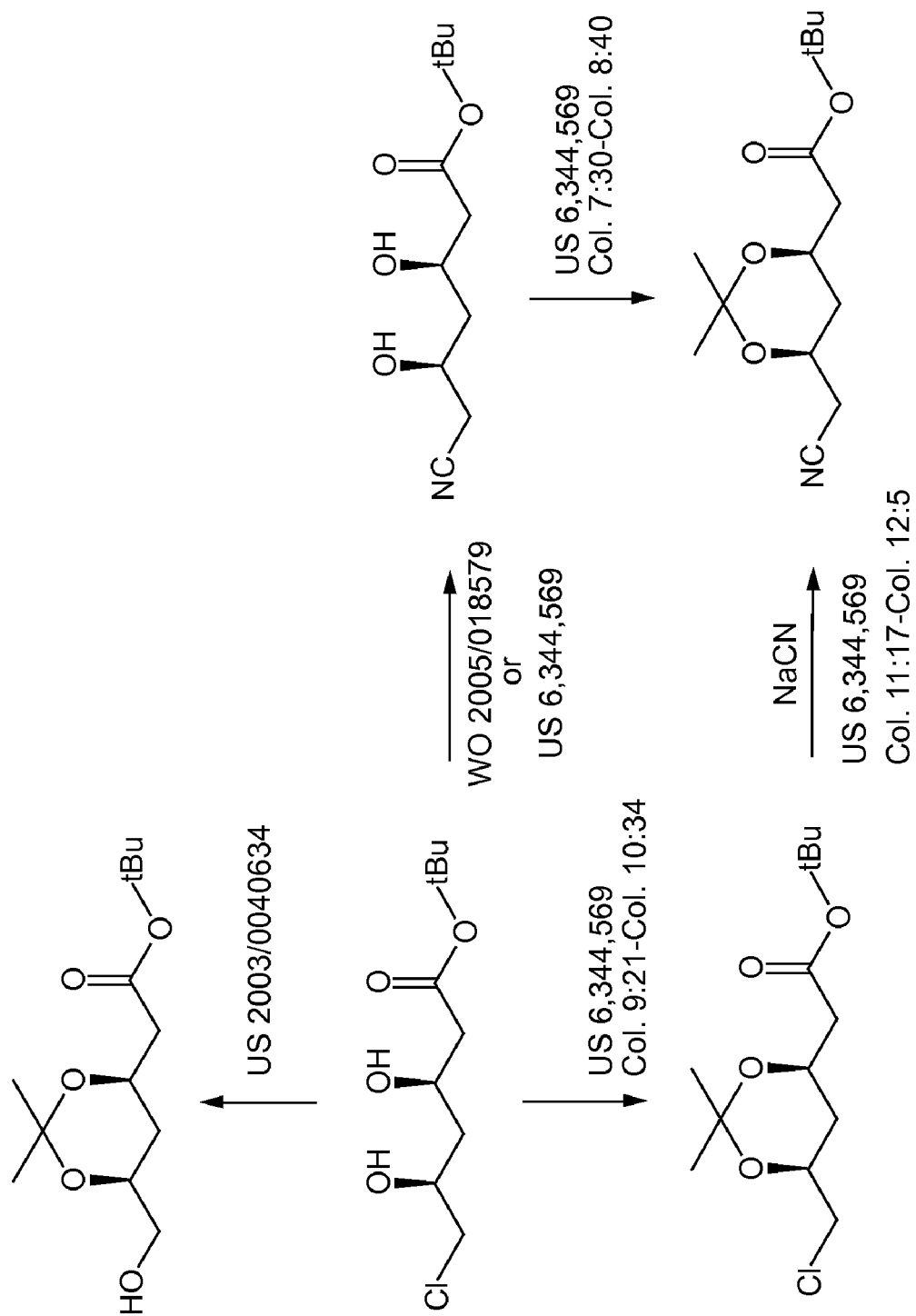
FIG. 2 illustrates various routes for synthesizing t-butyl (6R)-(2-cyanomethyl)-2,2 dimethyl-1,3-dioxane-(4R)-acetate from a t-butyl-3,5-dihydroxy-6-halohexanoate.

Exemplary embodiments of these and other reactions are illustrated in FIG. 2. Specific methods of synthesizing tert-butyl (4R,6R)-6-cyanomethyl-2,2-dimethyl1-1,3-dioxane-4-acetate from tert-butyl (3R,5R)-6-cyano-3,5-dihydroxyhexanoate and tert-butyl (4R,6S)-6-chloromethyl-2,2-dimethyl-1,3-dioxane-4-acetate from tert-butyl (3R,5S)-6-chloro-3,5-dihydroxyhexanoate are described in Example 2 and 3, respectively, of U.S. Pat. No. 6,344,569, the disclosure of which is incorporated herein by reference. A specific method for synthesizing tert-butyl (4R,6R)-6-cyanomethyl-2,2-dimethyl-1,3-dioxane-4-acetate from tert-butyl (4R,6S)-6-chloromethyl-2,2-dimethyl-1,3-dioxane-4-acetate is described in Example 3 of U.S. Pat. No. 6,344,569, the disclosure of which is incorporated herein by reference.

The protected and unprotected syn dihydroxy esters of structural formulas (IIa), (IIIa), (IVa), and (Va) can be used to synthesize cholesterol lowering statins, as well as other useful compounds including a 1,3-syn dihydroxy moiety, using methods that are well-known in the art. For example, methods of synthesizing atorvastatin using tert-butyl (3R,5R)-6-cyano-3,5-dihydroxyhexanoate are described in U.S. Pat. No. 6,596,879 (see especially Example 2 at Col. 14, line 22-58), and U.S. Pat. No. 5,097,045, the disclosures of which is incorporated herein by reference.

Methods of synthesizing rosuvastatin using tert-butyl (3R,5S)-6-chloro-3,5-dihydroxyhexanoate are described in U.S. Pat. No. 5,278,313 and U.S. Pat. No. 6,472,544, respectively, the disclosures of which are incorporated herein by reference. Methods of synthesizing rosuvastatin using tert-butyl (3R,5S,6)-trihydroxyhexanoate are described in PCT application no. WO 01/85975, the disclosure of which is incorporated herein by reference. Synthesis of other statins using the compounds produced by the methods herein will be apparent to the skilled artisan.

8. EXAMPLES

Various features and embodiments of the disclosure are illustrated in the following representative examples, which are intended to be illustrative, and not limiting.

In the following description, wherever glucose dehydrogenase (GDH) is used, it is GDH-CDX901, obtainable from Julich Chiral Solutions, Jülich, Germany.

8.1 Example 1

Wild-Type Ketoreductase Gene Acquisition and Construction of Expression Vectors The Ydl124wp gene (Genbank Acc. No.: NP_010159.1; GI: 6320079) encoding a *Saccharomyces cerevisiae* ketoreductase was codon optimized (SEQ ID NO:1) for expression in *E. coli* based on the amino acid sequence (SEQ ID NO:2) of the ketoreductase ("YDL") encoded by the Ydl124wp gene. The gene was synthesized using oligonucleotides composed of 42 nucleotides and cloned into expression vector pCK110900 (depicted in FIG. 5) under the control of a lac promoter. The expression vector also contained the P15a origin of replication and the chloramphenicol resistance gene. Resulting plasmids were transformed into *E. coli* W3110 using standard methods. Several clones were selected for sequencing the putative KRED-encoding gene. Genes having the desired designed sequence were identified and used as the starting material for the development of genes encoding engineered ketoreductases.

This Example illustrates the acquisition of a recombinant polynucleotide encoding the wild-type ketoreductase YDL from which genes encoding engineered ketoreductases can be derived, and expression vectors and host cells suitable for such engineering.

Polynucleotides encoding engineered ketoreductases of the present disclosure were likewise cloned into vector pCK110900 for expression in *E. coli* W3110.

8.2 Example 2

Production of Ketoreductase Powders; Shake Flask Procedure

A single microbial colony of *E. coli* containing a plasmid with the ketoreductase gene of interest was inoculated into 50 ml Luria Bertani broth containing 30 μg/ml chloramphenicol and 1% glucose. Cells were grown overnight (at least 16 hrs) in an incubator at 30° C. with shaking at 250 rpm. The culture was diluted into 250 ml Terrific Broth (12 g/L bacto-tryptone, 24 g/L yeast extract, 4 ml/L glycerol, 65 mM potassium phosphate, pH 7.0, 1 mM $MgSO_4$, 30 μg/ml chloramphenicol) in 1 liter flask) to an optical density at 600 nm ($OD_{600}$) of 0.2 and allowed to grow at 30° C. Expression of the ketoreductase gene was induced with 1 mM IPTG when the $OD_{600}$ of the culture is 0.6 to 0.8 and incubated overnight (at least 16 hrs). Cells were harvested by centrifugation (5000 rpm, 15 min, 4° C.) and the supernatant discarded. The cell pellet was resuspended with an equal volume of cold (4° C.) 100 mM triethanolamine (chloride) buffer, pH 7.0, and harvested by centrifugation as above. The washed cells were resuspended in two volumes of the cold triethanolamine (chloride) buffer and passed through a French Press twice at 12000 psi while maintained at 4° C. Cell debris was removed by centrifugation (9000 rpm, 45 min., 4° C.). The clear lysate supernatant was collected and stored at −20° C. Lyophilization of frozen, clear lysate provided a dry powder of crude ketoreductase enzyme.

This Example illustrates the production of ketoreductases powders suitable for use to test enzyme properties.

8.3 Example 3

Preparation of t-butyl 6-cyano-(5R)-hydroxy-3-oxohexanoate

To an 1 L 3-neck flask with an addition funnel and a PTFE-coated magnetic stirring bar, under a nitrogen atmosphere and immersed in a −20° C. dry ice/acetone bath, was added 120 mL anhydrous tetrahydrofuran and 75 mL (540 mmol) diisopropylamine. The solution was stirred and cooled to −20° C., and 200 mL (500 mmol) 2.5 M n-butyllithium in hexane was added dropwise over 45 minutes, giving a pale yellow solution. After an additional 30 minutes, 70 mL (520 mmol) t-butyl acetate was added dropwise with stirring over 25 minutes, turning the solution cloudy. After an additional 1 hour maintained at −20° C., a solution of 22.0 g ethyl 4-cyano-(3R)-hydroxybutyrate (>99.9% e.e., 140 mmol) in 30 mL anhydrous tetrahydrofuran was added dropwise with stirring over 35 minutes, giving a pale yellow solution. The solution was maintained at −20° C. for an additional 1 hour, then transferred via cannula over 30 minutes subsurface into a stirred biphasic mixture of 350 mL 1 M citric acid and 250 mL toluene immersed in an ice bath (~5° C.). During this quench, the temperature of the mixture was maintained between 5-10° C. Upon completion, the phases separated, giving a pale yellow organic phase above and an orange aqueous phase, pH ~6, below. The aqueous phase was separated and extracted with 250 mL toluene. The combined organic phases were washed with 100 mL 1 N HCl followed by 3×100 mL of distilled water. The final water wash gave pH ~5. The solvent was removed from the organic phase by rotary evaporation at 60° C. under vacuum to give 31.7 g of a yellow oil.

$^1$H-NMR of the oil showed the presence of t-butyl 6-cyano-(5R)-hydroxy-3-oxohexanoate, t-butyl 3-oxobutyrate, and t-butyl 4-cyano-(3R)-hydroxybutyrate in 1.00:0.27:0.14 mole ration, corresponding to 77 weight % t-butyl 6-cyano-(5R)-hydroxy-3-oxohexanoate if no other components are present. The actual weight % was likely slightly lower, but was not more accurately measured. 77 weight % of 31.7 g oil corresponds to a 77% mole yield on ethyl 4-cyano-(3R-hydroxybutyrate (theoretical yield=31.8 g).

This and similarly prepared crude t-butyl 6-cyano-(5R)-hydroxy-3-oxohexanoate, typically having purity ranging from 60 to 75 weight %, the balance being t-butyl 3-oxobutyrate and t-butyl 4-cyano-(3R)-hydroxybutyrate, were used in the following Examples, except when the purified substrate is specified. The specified amounts of t-butyl 6-cyano-(5R)-hydroxy-3-oxohexanoate used in the Examples refer to the amount of the crude preparation, uncorrected for its actual composition.

8.4 Example 4

LC/MS/MS Assay for Substrate Specificity and Conversion

An LC/MS/MS method was developed to analyze the conversion of t-butyl 6-cyano-(5R)-hydroxy-3-oxohexanoate to t-butyl 6-cyano-(3R,5R)-dihydroxyhexanoate and the possible conversion of t-butyl 3-oxobutyrate in the crude substrate (Example 4) to t-butyl 3-hydroxybutyrate:

| | |
|---|---|
| Instrument: | Agilent 1100 with Waters Micromass Quattro Premier LC/MS/MS |
| Column: | Agilent SB C18 (50 mm × 4.6 mm, 5 μm) |
| Mobile phase: | 50% aqueous 0.25 vol % acetic acid, 50% acetonitrile |
| Flow rate: | 1.0 mL/min. |
| Backpressure: | 60 bar |
| Temperature: | ambient room temperature |
| Injection: | 5 μL, ~0.1 mg/ml in methanol or other water miscible solvent. |
| Retention | t-butyl 6-cyano-(3R,5R)-dihydroxyhexanoate 1.0 min. |

-continued

| times: | t-butyl 6-cyano-(5R)-hydroxy-3-oxohexanoate | 1.3 min. |
| | t-butyl 3-hydroxybutyrate | 1.5 min. |
| | t-butyl 3-oxobutyrate | 2.1 min. |
| Ionization/ Detection: | APCI+ using the transitions MH+ > MH-56 (loss of t-butene) | |

The response ratio for t-butyl 6-cyano-(3R,5R)-dihydroxyhexanoate to t-butyl 6-cyano-(5R)-hydroxy-3-oxohexanoate substrate was typically 0.84 at 0.1 mg/ml. The MS/MS transitions for t-butyl 3-oxobutyrate and t-butyl 3-hydroxybutyrate were not optimized.

8.5 Example 5

Diastereomeric Analysis of t-butyl-6-cyano-3,(5R)-dihydroxyhexanoate by LC/MS/MS An LC/MS/MS method was developed to separate and analyze the (3R,5R) and (3S,5R) diastereomers of t-butyl 6-cyano-3,(5R)-dihydroxyhexanoate. The LC conditions provided baseline resolution of the diastereomers. The response was linear from 0.0001 to 1.0 mg/ml with a detection limit under 0.0001 mg/ml.
Instrument: Agilent 1100 with Waters Micromass Quattro Premier LC/MS/MS
  Column: Agilent SB C8 (50 mm×4.6 mm, 5 μm)
  Mobile phase: Isocratic 65% of 0.25% aq acetic acid, 35% acetonitrile
  Flow rate: 1.0 mL/min.
  Temperature: ambient room temperature
  Retention times: (3S,5R) 12.77 min: (3R,5R) 13.67 min.
  Ionization/Detection: APCI+ using the transitions MH+>MH-56 (loss of t-butene)

8.6 Example 6

Diastereomeric Analysis of t-butyl (6R)-cyanomethyl-2,2-dimethyl-1,3-dioxane-4-acetate by Gas Chromatography A GC/MS method was developed to separate and analyze the (4R,6R) and (4S,6R) diastereomers of t-butyl (6R)-cyanomethyl-2,2-dimethyl-1,3-dioxane-4-acetate:
  Column: HP5MS (0.25 mm i d, 25 μm df, 30 m)
  Carrier gas: Helium, 9.44 psi, 0.7 mL/minute.
  Oven: 60° C. for 1 min, then 15° C./min to 280° C., then hold at 280° C. for 2 min.
  Retention Times: (4S,6R) 11.44 min; (4R,6R) 11.55 min.
  Detection: total ion count

8.7 Example 7

Diastereomeric Analysis of t-butyl-6-cyano-3,(5R)-dihydroxyhexanoate via derivatization to t-butyl (6R)-cyanomethyl-2,2-dimethyl-1,3-dioxane-4-acetate To a 30 mg sample comprising t-butyl 6-cyano-3,(5R)-dihydroxyhexanoate was added 1 mL of ethyl acetate, 200 μL of 2,2-dimethoxypropane, and 20 μL of methanesulfonic acid. The mixture was stirred for 20 minutes at room temperature. After addition of 200 μL of saturated aqueous sodium bicarbonate, a sample of the top ethyl acetate layer was analyzed by the method of Example 6.

Each of the (3R,5R) and (3S,5R) diastereomers of t-butyl-6-cyano-3,(5R)-dihydroxyhexanoate are quantitatively derivatized under these conditions. Accordingly the 3,(5R) diastereomeric composition of the t-butyl-6-cyano-3,(5R)-dihydroxyhexanoate corresponds to the analyzed 4,(6R) diastereomeric composition of the (6R)-cyanomethyl-2,2-dimethyl-1,3-dioxane-4-acetate derivative.

8.8 Example 8

Evaluation of Wild-Type Ketoreductase YDL for Activity to Reduce t-butyl 6-cyano-(5R)-hydroxy-3-oxohexanoate To a reaction mixture of 950 μL 100 mM triethanolamine (chloride) buffer, pH 7.0, 200 μL isopropanol, 9 mg t-butyl 6-cyano-(5R)-hydroxy-3-oxohexanoate and 8 mg NAD(P)H was added 15 mg ketoreductase powder comprising ketoreductase YDL. The reaction mixture was stirred at room temperature for 24 hours, then extracted with 1 mL ethyl acetate. After centrifugation, the organic phase was separated and the solvent was removed by rotary evaporation to leave a nonvolatile oil. The nonvolatile oil was analyzed by the method of Example 4 for the conversion of the t-butyl 6-cyano-(5R)-hydroxy-3-oxohexanoate and, if present, the diastereomeric composition of the product, t-butyl 6-cyano-(3,5R)-dihydroxyhexanoate by the method of Example 7. The analyses showed 85% conversion of the t-butyl 6-cyano-(5R)-hydroxy-3-oxohexanoate to produce t-butyl 6-cyano-(3R,5R)-dihydroxyhexanoate having >99% d.e.

The Example illustrates the identification of wild-type ketoreductase YDL as a candidate for engineering to improve properties for the reduction of a 3-oxo group of an enantiomer of a 5-hydroxy-3-oxohexanoate ester to yield the corresponding syn 3,5-dihydroxyhexanoate ester.

8.9 Example 9

Evaluation of Wild-Type Ketoreductase YDL for Activity to Reduce t-butyl 6-cyano-(5R)-hydroxy-3-oxohexanoate Using Glucose and Glucose Dehydrogenase for Cofactor Regeneration To a reaction mixture of 1 mL 100 mM triethanolamine (chloride) buffer, pH 7.0, 100 μL butyl acetate, 20 mg t-butyl 6-cyano-(5R)-hydroxy-3-oxohexanoate, 1 mg NAD(P)+, and 35 mg glucose, was added 3 mg of glucose dehydrogenase powder and 20 mg ketoreductase powder comprising ketoreductase YDL. The reaction mixture was stirred at room temperature for 22 hours, then extracted with 1 mL ethyl acetate. After centrifugation, the organic phase was separated and the solvent was removed by rotary evaporation to leave a nonvolatile oil. The nonvolatile oil was analyzed by the method of Example 4 for the conversion of the t-butyl 6-cyano-(5R)-hydroxy-3-oxohexanoate and, if present, the diastereomeric composition of the product, t-butyl 6-cyano-(3,5R)-dihydroxyhexanoate by the method of Example 5. The analyses showed 92.6% conversion of the t-butyl 6-cyano-(5R)-hydroxy-3-oxohexanoate to produce t-butyl 6-cyano-(3R,5R)-dihydroxyhexanoate having >99.9% d.e.

The Example illustrates the evaluation of wild-type ketoreductase YDL for activity and diastereoselectivity when used in combination with a cofactor regeneration system (glucose and glucose dehydrogenase).

8.10 Example 10

Evaluation of Substrate and Cofactor Specificities of Wild-Type Ketoreductase YDL in the Reaction to Reduce Crude t-butyl 6-cyano-(5R)-hydroxy-3-oxohexanoate The specificity of wild-type ketoreductase YDL powder for the reductions of t-butyl-(R)-5-hydroxy-3-oxohexanoate and of t-butyl 3-oxobutyrate by NADH and NADPH was evaluated by measuring the increase in NAD(P) absorbance at 340 nm in reaction mixtures comprising 3 mg/mL purified t-butyl-(R)-5-hydroxy-3-oxohexanoate or ~13 mM t-butyl 3-oxobutyrate and 0.2-0.3 mM NADH or NADPH in the total volume of 1 mL 100 mM triethanolamine (chloride) buffer, pH 7.2.

Ketoreductase YDL powder was active for the reduction of t-butyl-(R)-5-hydroxy-3-oxohexanoate by NADPH but not by NADH. Ketoreductase YDL powder showed only very low activity for the reduction of t-butyl 3-oxobutyrate by NADPH, relative to that on t-butyl-(R)-5-hydroxy-3-oxohexanoate.

8.11 Example 11

High Throughput Assay for Ketoreductase Activity on t-butyl 6-cyano-(5R)-hydroxy-3-oxohexanoate A. High Throughput NAD(P)H Fluorescence Assay: Library colonies were picked using a Q-bot® robotic colony picker (Genetix USA, Inc., Beaverton, Oreg.) into 96-well shallow well microtiter plates containing 180 µL Luria Bertani broth (LB), 1% glucose and 30 µg/mL chloramphenicol (CAM). Cells were grown overnight at 30° C. with shaking at 250 rpm. 13 µL of this culture was then transferred into 96-deep well plates containing 400 µL Terrific broth (TB) and 30 µg/mL CAM. After incubation of deep-well plates at 30° C. with shaking at 250 rpm for 2.5 to 3 hours ($OD_{600}$ 0.6-0.8), recombinant gene expression by the cell cultures was induced by isopropyl thiogalactoside (IPTG) to a final concentration of 1 mM. The plates were then incubated at 30° C. with shaking at 250 rpm for overnight.

Cells were pelleted via centrifugation, resuspended in 300 to 400 µL lysis buffer and lysed by shaking at room temperature for at least 2 hours. The lysis buffer contained 100 mM triethanolamine (chloride) buffer, pH 7.0-7.2, 1 mg/mL lysozyme and 500 µg/mL polymixin B sulfate.

Ketoreductase activity was measured by transferring measured quantities of the lysis mixtures into the wells of microtiter plates containing an assay mixture of 100 mM triethanolamine (chloride) buffer, pH 7-7.2, 0.2-0.3 mM NAD(P)H, 2 to 3 mg/mL t-butyl 6-cyano-(5R)-hydroxy-3-oxohexanoate, 0 to 2 mg/ml t-butyl 6-cyano-(3R,5R)-dihydroxyhexanoate, 0 to 600 mM glucose and 0 to 600 mM sodium gluconate. The reactions were monitored by measuring the decrease of fluorescent emission of NAD(P)H at 440 nm as a function of time. The results were plotted as relative fluorescent units (RFU) of NAD(P)H verses time and the slope of the plot (RFU/min) was used to determine the rate of reaction.

B. Medium Throughput LC/MS/MS Assay for Substrate Specificity and Conversion: To determine the extent to which the NAD(P)H consumption measured in the fluorescence assay was due to conversion of the t-butyl 6-cyano-(5R)-hydroxy-3-oxohexanoate substrate to t-butyl 6-cyano-(3R,5R)-dihydroxyhexanoate product or to reduction of t-butyl 3-oxobutyrate in the crude substrate to t-butyl 3-hydroxybutyrate, the reaction mixtures showing NAD(P)H consumption activity of interest were consolidated into fewer 96-well microtiter plates and extracted with ethyl acetate. The separated ethyl acetate extracts were diluted with acetonitrile/water (1/1) and analyzed by the LC/MS/MS method of Example 4.

8.12 Example 12

High Throughput Screen for More Stable Engineered Ketoreductases

Lysis mixtures comprising engineered ketoreductases prepared and identified as in Example 11A were incubated for at least 16 hrs at a temperature in the range of 37° C. to 50° C. The ketoreductase activity remaining in the lysis mixtures after the incubation was then measured at ambient temperature by the procedure of Example 4. The ratio of the ketoreductase activity remaining after the incubation to the activity of the corresponding unincubated lysis mixture, 0 to 1, was used a measure of the stability of the engineered ketoreductase in the lysis mixture.

8.13 Example 13

Improved Activity of Engineered Ketoreductases Derived from Wild-Type YDL for the Reduction of t-butyl 6-cyano-(5R)-hydroxy-3-oxohexanoate to t-butyl 6-cyano-(3R,5R)-dihydroxyhexanoate To a 25 mL three-neck vessel equipped with a PTFE-coated magnetic stirring bar and a pH electrode connected to an automatic titrator for pH-controlled addition of base on-demand via a feeding tube into the vessel, was charged 19 mL 100 mM triethanolamine (chloride) buffer, pH 7, 3.0 g glucose, ketoreductase powder comprising the ketoreductase specified by SEQ ID NOS. in Table 2 in the amount specified in Table 2, 13 mg glucose dehydrogenase powder, 1.0 mg NaNADP, and lastly 3 g t-butyl 6-cyano-(5R)-hydroxy-3-oxohexanoate. The reaction mixture was stirred at 22° C. The automatic titrator maintained the pH at 7 by the addition of 4N NaOH, which was continuously recorded. Reaction progress was monitored by the rate and cumulative addition of the base and periodic sampling of the reaction mixture for extraction and analysis by the method of Example 4. After the reaction time specified in Table 2, the reaction mixture was extracted twice with 10 mL ethyl acetate twice. The combined organic extract was filtered through a short pad of diatomaceous earth and the solvent was removed by rotary evaporation under vacuum. Diastereomeric analysis of the residual oil by the method of Example 5 showed the product t-butyl 6-cyano-(3R,5R)-dihydroxyhexanoate from each such reaction reported Table 2 to have >99.99% diastereopurity. (No other diastereomers were detectable.)

Table 2 gives the SEQ ID NOS. corresponding to the ketoreductase powder, the number of amino acid mutations from the wild-type ketoreductase YDL, the amount of ketoreductase powder used, the reaction time, and the conversion of t-butyl 6-cyano-(5R)-hydroxy-3-oxohexanoate to t-butyl 6-cyano-(3R,5R)-dihydroxyhexanoate reached in that reaction time.

This Example illustrates, by comparisons of ketoreductase amounts, reaction times, and conversions in Table 2, engineered ketoreductases derived from the wild-type ketoreductase YDL providing improved activity compared to ketoreductase YDL.

TABLE 2

Activities of engineered ketoreductases derived from YDL.

| ketoreductase SEQ ID NO. | mutations from YDL | ketoreductase amount (mg) | reaction time (h) | conversion (%) |
|---|---|---|---|---|
| 2 (YDL) | 0 | 120 | 67 | 87 |
| 70 | 3 | 120 | 67 | 99.6 |
| 112 | 4 | 60 | 24 | 94 |
| 178 | 7 | 30 | 24 | 95 |
| 276 | 8 | 30 | 23 | 96 |
| 278 | 8 | 30 | 22 | 99.0 |
| 318 | 9 | 30 | 5 | 99.7 |

8.14 Example 14

Improved Stability of Engineered Ketoreductases Derived from Wild-Type YDL for the Reduction of t-butyl 6-cyano-(5R)-hydroxy-3-oxohexanoate to t-butyl 6-cyano-(3R,5R)-dihydroxyhexanoate To a 25 mL three-neck vessel equipped with a PTFE-coated magnetic stirring bar and a pH electrode connected to an automatic titrator for pH-controlled addition of base on-demand via a feeding tube into the vessel, was charged 20 mL 100 mM triethanolamine (chloride) buffer, pH 7, 0.5 g glucose, the amount of ketoreductase powder specified in Table 3, 8 mg glucose dehydrogenase, 2.0 mg NaNADP, and lastly 0.3 g t-butyl 6-cyano-(5R)-hydroxy-3-oxohexanoate. The reaction mixture was stirred at the temperature specified in Table 3. The automatic titrator maintained the pH at 7 by the addition of 4N NaOH, which was continuously recorded. Reaction progress was monitored by the rate and cumulative addition of the base and periodic sampling of the reaction mixture for extraction and analysis by the method of Example 4. After 22 hours, the reaction mixture was extracted twice with 10 mL ethyl acetate twice. The combined organic extract was filtered through a short pad of diatomaceous earth and the solvent was removed by rotary evaporation under vacuum. Analysis of the residual oil by the method of Example 5 showed the product t-butyl 6-cyano-(3R,5R)-dihydroxyhexanoate from each such reaction reported Table 3 having >99.99% diastereopurity. (No other diastereomers was detectable.)

Table 3 gives the SEQ ID NOS. corresponding to the ketoreductase powder, the number of amino acid mutations from the wild-type ketoreductase YDL, the amount of ketoreductase powder used, the temperature of the reaction, and the conversion of t-butyl 6-cyano-(5R)-hydroxy-3-oxohexanoate to t-butyl 6-cyano-(3R,5R)-dihydroxyhexanoate reached at the specified cumulative reaction time.

This Example illustrates, by comparisons of the ketoreductase amounts, reaction times, and conversions in Table 3 engineered ketoreductases derived from the wild-type ketoreductase YDL providing improved stability compared to YDL. While in the reaction at 22° C., YDL retained activity and the reaction reached 75% conversion in 22 hours, in the reaction at 30° C., YDL lost all activity within 3 hours reaching only 25% conversion. The engineered ketoreductase having the amino acid sequence SEQ ID NO. 156 is partially improved in stability; it retained beyond 3 hours at 30° C., but lost all activity within 17 hours, having reached 78% conversion. The engineered ketoreductase having the amino acid sequence SEQ ID NO. 312 retained activity beyond 17 hours at 30° C. and reached essentially complete conversion within 22 hours.

8.15 Example 15

Improved Activity and Diastereoselectivity of Engineered Ketoreductases Derived from Wild-Type YDL for the Reduction of t-butyl 6-chloro-(5S)-hydroxy-3-oxohexanoate to t-butyl 6-chloro-(3R,5S)-dihydroxyhexanoate To a 50 mL three-neck vessel equipped with a PTFE-coated magnetic stirring bar and a pH electrode connected to an automatic titrator for pH-controlled addition of base on-demand via a feeding tube into the vessel, was charged 21 mL 100 mM triethanolamine (chloride) buffer, pH 7, 0.5 g glucose, 2 mL of the same buffer containing 10 mg of ketoreductase powder comprising the ketoreductase specified by SEQ ID NO. in Table 4, 10 mg glucose dehydrogenase powder, 2.0 mg NAD or NaNADP, and lastly 0.3 g t-butyl 6-chloro-(5S)-hydroxy-3-oxohexanoate. The reaction mixture was stirred at 22° C. The automatic titrator maintained the pH at 6.9 by the addition of 4N NaOH, which was continuously recorded. Reaction progress was monitored by the rate and cumulative addition of the base and periodic sampling of the reaction mixture for extraction and analysis by the method of Example 4. After the reaction time specified in Table 4, the reaction mixture was extracted twice with 10 mL ethyl acetate twice. The combined organic extract was filtered through diatomaceous earth and the solvent was removed by rotary evaporation under vacuum to give 0.2 g residual oil.

Diastereopurity of the t-butyl 6-chloro-(3R,5S)-dihydroxyhexanoate product in the residual oil was determined by the method of Example 7. The (3R,5S)-diol is a syn diastereomer. (The convention for labeling the 5-position R or S is reversed between 6-cyanomethyl and 6-chloromethyl.)

Table 4 gives the SEQ ID NOS. corresponding to the ketoreductase powder, the number of amino acid mutations from the wild-type ketoreductase YDL, the amount of ketore-

TABLE 3

Activities of YDL and engineered ketoreductases derived from YDL.

| ketoreductase SEQ ID NO. | mutations from YDL | ketoreductase amount (mg) | temperature (° C.) | conversion (%) | | |
|---|---|---|---|---|---|---|
| | | | | at 3 hours | at 17 hours | at 22 hours |
| 2(YDL) | 0 | 30 | 22 | 29 | 50 | 75 |
| 2(YDL) | 0 | 30 | 30 | 25 | 25 | 25 |
| 154 | 7 | 30 | 30 | 43 | 78 | 78 |
| 312 | 11 | 30 | 30 | 40 | 90 | >99 |
| 316 | 9 | 10 | 30 | 33 | 92 | 96 | ductase powder used, the cofactor used, the reaction time, the conversion of t-butyl 6-chloro-(5S)-hydroxy-3-oxohexanoate, and the diastereopurity of the t-butyl 6-chloro-(3R, 5S)-dihydroxyhexanoate product.

This Example illustrates an engineered ketoreductases derived from the wild-type ketoreductase YDL providing improved activity and improved diastereoselectivity compared to ketoreductase YDL and the use of such engineered ketoreductases for the preparation of t-butyl 6-chloro-(3R, 5S)-dihydroxyhexanoate.

TABLE 4

Activities and stereoselectivities of YDL and engineered ketoreductases derived from YDL to produce t-butyl 6-chloro-(3R,5S)-dihydroxyhexanoate.

| cofactor | ketoreductase SEQ ID NO. | mutations from YDL | reaction time (h) | conversion (%) | d.e. (%) (3R,5S) |
|---|---|---|---|---|---|
| NADP | 2(YDL) | 0 | 20 | 37 | 97.3 |
| | 326 | 10 | 4 | 99.8 | 99.2 |
| | 328 | 11 | 4 | 99.6 | 99.4 |
| NAD | 2(YDL) | 0 | 20 | 28 | 98.9 |
| | 326 | 10 | 5 | 99.5 | 99.8 |
| | 328 | 11 | 20 | 98.5 | 99.6 |

8.16 Example 16

Reduction of t-butyl 6-cyano-(5R)-hydroxy-3-oxohexanoate t-butyl 6-cyano-(3R,5R)-dihydroxyhexanoate by an Engineered Ketoreductase Using Isopropanol and a Secondary Alcohol Dehydrogenase for Cofactor Regeneration To a reaction mixture of 2 mL 100 mM triethanolamine (chloride) buffer, pH 7.2, containing 2 mM $MgSO_4$, 360 mg t-butyl 6-cyano-(5R)-hydroxy-3-oxohexanoate, and 200 µL isopropanol, were added 30 mg ketoreductase powder comprising the engineered ketoreductase having the amino acid sequence of SEQ ID NO. 330, secondary alcohol dehydrogenase powder comprising an engineered secondary alcohol dehydrogenase derived from ADH-LK and having activity to oxidize isopropanol to acetone, and 5 mg NaNADP. The reaction mixture was stirred at room temperature for 1 hour, then extracted with 1 mL ethyl acetate. After centrifugation, the organic phase was separated and the solvent was removed by rotary evaporation to leave a nonvolatile oil. The nonvolatile oil was analyzed by the methods of Examples 4 and 7. The t-butyl 6-cyano-(5R)-hydroxy-3-oxohexanoate was 100% converted to t-butyl 6-cyano-(3R,5R)-dihydroxyhexanoate with >99.9% d.e. (=>99.95% diastereoselectivity).

This Example illustrates the reduction of the 3-oxo group of an enantiomer of a 5-hydroxy-3-oxohexanoate ester to yield the corresponding syn 3,5-dihydroxyhexanoate ester using an engineered ketoreductase in combination with a cofactor regeneration system comprising a secondary alcohol (isopropanol) and a secondary alcohol dehydrogenase.

8.17 Example 17

Preparation of t-butyl 6-cyano-(3R,5R)-dihydroxyhexanoate (a Compound of Structural Formula IIa)

To a 100 mL three-neck flask equipped with a PTFE-coated magnetic stirring bar and a pH electrode connected to an automatic titrator for pH-controlled addition of base on-demand via a feeding tube into the flask, was charged 19 mL 100 mM triethanolamine (chloride) buffer, pH 7, 8.68 g glucose, 100 mg ketoreductase powder comprising the engineered ketoreductase having the amino acid sequence SEQ ID NO. 316, 40 mg glucose dehydrogenase powder, 6 mg NaNADP, and lastly 12 g t-butyl 6-cyano-(5R)-hydroxy-3-oxohexanoate. The reaction mixture was stirred at 22° C. The automatic titrator maintained the pH at 6.9 by the addition of 4N NaOH, which was continuously recorded. After 22 hours, 8.9 ml 4 N NaOH had been consumed, and an extract of a sample analyzed by the method of Example 4 showed >99% conversion. The reaction mixture was filtered through diatomaceous earth and 20 mL ethyl acetate was added through the diatomaceous earth. The aqueous phase was separated and extracted with 20 mL ethyl acetate. The solvent was removed from the combined organic extracts by rotary evaporation under vacuum to obtain 9.80 g crude t-butyl 6-cyano-(3R, 5R)-dihydroxyhexanoate as an oil.

This Example illustrates the preparation and recovery of a syn 3,5-dihydroxyhexanoate ester using an engineered ketoreductase by the method of the invention.

8.18 Example 18

Preparation of t-butyl (6R)-cyanomethyl-2,2-dimethyl-1,3-dioxane-(4R)-acetate (a Compound of Structural Formula IVa)

To the 9.80 g crude t-butyl 6-cyano-(3R,5R)-dihydroxyhexanoate obtained in Example 17 was added 26 mL 2,2-dimethoxypropane and 260 µL methanesulfonic acid. The mixture was stirred at for 2 hours at 22° C. After addition of 25 mL 5% (half saturated) aqueous sodium bicarbonate, the pH of the aqueous phase was 7.5. The mixture was extracted with 52 mL heptane, and the separated organic phase was extracted with 25 mL 5% aqueous sodium bicarbonate. The solvents were removed from the organic phase by rotary evaporation under vacuum. The residue was taken up in 70 mL heptane with mild heating (~45° C.), cooled and maintained at room temperature for 30 minutes, then cooled maintained at 0° C. to complete the crystallization. Filtration and drying yielded at 8.1 g t-butyl (6R)-cyanomethyl-2,2-dimethyl-1,3-dioxane-(4R)-acetate as a slightly yellow solid. Analysis by the method of Example 6 showed 97.8 area % purity and no detectable (4S,6R) diastereomer.

This Example illustrates the preparation and recovery of a protected syn dihydroxy hexanoate ester from a syn 3,5-dihydroxyhexanoate ester prepared by the method of the invention.

8.19 Example 19

Preparation of t-butyl 6-cyano-(3R,5R)-dihydroxyhexanoate

To a jacketed 3 L three-neck flask equipped with a PTFE-coated magnetic stirring bar, an addition funnel, and a pH electrode connected to an automatic titrator for pH-controlled addition of base on-demand via a feeding tube into the flask, was charged 6.36 g triethanolamine and 427 mL water. The pH of the solution was adjusted to 6.9 by addition of 3.85 g concentrated hydrochloric acid. 195 g D-glucose, 0.90 g glucose dehydrogenase powder, 2.25 g ketoreductase powder comprising the engineered ketoreductase having the amino acid sequence SEQ ID NO. 316, and 0.135 g NaNADP were added. With stirring at 22° C. and the automatic titrator prepared to provide 4N NaOH on demand, 270 g t-butyl 6-cyano- (5R)-hydroxy-3-oxohexanoate was added from the addition funnel. The automatic titrator maintained the pH at 6.9 by the addition of 4N NaOH, which was continuously recorded. After 22 hours, 196.7 mL 4 N NaOH had been consumed, and an extract of a sample analyzed by the method of Example 4 showed >99% conversion. 450 mL ethyl acetate was added and the mixture was filtered through diatomaceous earth. The aqueous phase was separated and extracted with 450 mL ethyl acetate. The solvent was removed from the combined organic extracts by rotary evaporation under vacuum to obtain 232 g crude t-butyl 6-cyano-(3R,5R)-dihydroxyhexanoate as an oil.

This Example illustrates a larger scale preparation and recovery of a syn 3,5-dihydroxyhexanoate ester using an engineered ketoreductase by the method of the invention.

8.20 Example 20

Reduction of t-butyl
6-cyano-(5S)-hydroxy-3-oxohexanoate

The S-enantiomer of t-butyl 6-cyano-5-hydroxy-3-oxohexanoate was prepared from ethyl 4-cyano-(3S)-hydroxybutyrate (98% e.e.) following a procedure analogous to the preparation of the R-enantiomer from ethyl 4-cyano-(3S)-hydroxybutyrate described in Example 3.

To a 25 mL three-neck vessel equipped with a PTFE-coated magnetic stirring bar and a pH electrode connected to an automatic titrator for pH-controlled addition of base on-demand via a feeding tube into the vessel, was charged 20 mL 100 mM triethanolamine (chloride) buffer, pH 7, 1.80 g glucose, 9 mg glucose dehydrogenase powder, 30 mg ketoreductase powder comprising the engineered ketoreductase having the amino acid sequence SEQ ID NO. 316, 2.5 mg NaNADP, and lastly 3 g t-butyl 6-cyano-(5S)-hydroxy-3-oxohexanoate. The reaction mixture was stirred at 22° C. The automatic titrator maintained the pH at 7 by the addition of 4N NaOH, which was continuously recorded. Reaction progress was monitored by the rate and cumulative addition of the base and periodic sampling of the reaction mixture for extraction and analysis by the method of Example 4. After 38 hours, the conversion was 47%. The reaction was extracted with twice with 10 mL ethyl acetate. The combined organic extract was filtered through diatomaceous earth and the solvent was removed by rotary evaporation under vacuum to leave an oil.

Crude t-butyl 6-cyanomethyl-2,2 dimethyl-1,3-dioxane-4-acetate was obtained from the oil (Example 7) and analyzed by the method of Example 6, showing 95.3% d.e. (4R,6S) diastereomer, corresponding to the ((3R,5S) diastereomer of the diol product of the reduction reaction. (Note: The (4R,6S) diastereomer has the same retention time as its (4S,6R) enantiomer, and the (4S,6S) diastereomer has the same retention time as its (4R,6R) enantiomer.)

When the engineered ketoreductase of this example is used to reduce the R-enantiomer of t-butyl 6-cyano-5-hydroxy-3-oxohexanoate, it provides the syn (3R,5R) diol in essentially perfect diastereoselectivity (see Examples 13, 14, and FIG. 6 and FIG. 7) This example illustrates that it is also 3R-selective when used to reduce the 5S-enantiomer of t-butyl 6-cyano-5-hydroxy-3-oxohexanoate.

8.21 Example 21

Reduction of a 97% 5R, 3% 5S mixture of
enantiomers of t-butyl
6-cyano-5-hydroxy-3-oxohexanoate (94% e.e.)

The procedure was identical to the preceding Example with the exception that 2.91 g t-butyl 6-cyano-(5R)-hydroxy-3-oxohexanoate and 0.09 g t-butyl 6-cyano-(5S)-hydroxy-3-oxohexanoate were added to the reaction. The reaction reached 97% conversion in 20 hours, after which point the product oil was recovered as in the preceding example.

Crude t-butyl (4,6)-6-cyanomethyl-2,2 dimethyl-1,3-dioxane-4-acetate was obtained from the oil (Example 7) and analyzed by GC/MS by the method of Example 6, showing a mixture of 99.73% (4R,6R) diastereomer, corresponding to the syn-(3R,5R) diastereomer of the diol, and 0.27% of the (4R,6S) diastereomer, corresponding to the (3R,5S) diastereomer of the diol (i.e., 99.46% d.e.).

In combination with the preceding Example, this Example illustrates an engineered ketoreductase having stereospecificity for reduction of the R-enantiomer of t-butyl 6-cyano-5-hydroxy-3-oxohexanoate over the S-enantiomer. The stereopurity at the 5-position of the (3R,5)-diol (and the 6-position of the (4R,6)-dioxane derived therefrom) is substantially upgraded compared to that of the 5-hydroxy-3-oxohexanoate substrate, 99.46% d.e. vs. 94% e.e. The engineered ketoreductase reacted less than one tenth of the 3% S-substrate added to the reaction, while reacting essentially all of the 97% R-substrate. Thus, engineered ketoreductases of the present disclosure can provide a higher degree of stereopurity in the syn-3,5-dihydroxyhexanoate product when the 5-hydroxy-3-oxohexanoate substrate is of lower stereopurity. Further, when the 5-hydroxy-3-oxohexanoate substrate is prepared from a 3-hydroxybutyrate ester, as exemplified in Example 3, a higher degree of stereopurity in the syn-3,5-dihydroxyhexanoate product can be obtained, in net, from 3-hydroxybutyrate ester of lower stereopurity.

8.22 Example 22

Diastereopurity of t-butyl
6-cyano-(3R,5R)-dihydroxyhexanoate Prepared by
the Method of the Invention Crude t-butyl 6-cyano-(3R,5R)-dihydroxyhexanoate was prepared as an oil by the method of Example 17. A sample of the oil was dissolved at 1.0 mg/mL in 9% acetonitrile in water and analyzed by the LC/MS/MS method of Example 5. The chromatogram is shown, blown up in scale in FIG. 6, upper panel. No diastereomer of t-butyl 6-cyano-(3R,5R)-dihydroxyhexanoate was detected above 0.005%.

For comparison, a solution of t-butyl 6-cyano-(3R,5R)-dihydroxyhexanoate was prepared from crystalline t-butyl (6R)-(2-cyanoethyl)-2,2-dimethyl-1,3-dioxane-(4R)-acetate obtained from a commercial source (Aldrich Cat# 53, 901-5), containing 0.1% of the (4S,6R) diastereomer (analyzed by the method of Example 6; see Example 23). 250 mg of the commercial t-butyl (6R)-(2-cyanoethyl)-2,2-dimethyl-1,3-dioxane-(4R)-acetate was suspended in 2 mL 1:1 methanol:water containing 200 µL 1N HCl. The mixture was stirred for 16 hours at room temperature. 500 µL saturated aqueous sodium bicarbonate and 5 mL of ethyl acetate were added. The organic phase was separated and solvents were removed by rotary evaporation under vacuum to yield 187 mg t-butyl 6-cyano-(3R,5R)-dihydroxyhexanoate as a slightly yellow oil.

A sample of this oil was dissolved at 1.0 mg/mL in 9% acetonitrile in water and also analyzed by the LC/MS/MS method of Example 5. The chromatogram is shown, blown up in scale, in FIG. 6, lower panel. The chromatogram shows the peak for the 0.1% (3S,5R) diastereomer of t-butyl 6-cyano-3,5-dihydroxyhexanoate resulting from the 0.1% of the (4S, 6R) diastereomer in the commercial t-butyl (6R)-(2-cyanoethyl)-2,2-dimethyl-1,3-dioxane-(4R)-acetate.

8.23 Example 23

Diastereopurity of Uncrystallized t-butyl (6R)-(2-cyanoethyl)-2,2-dimethyl-1,3-dioxane-(4R)-acetate Prepared by the Method of the Invention Crude t-butyl 6-cyano-(5R)-hydroxy-3-oxohexanoate prepared from ethyl 4-cyano-(3R)-hydroxybutyrate of >99.9% e.e. in Example 3 was converted to t-butyl (6R)-(2-cyanoethyl)-2,2-dimethyl-1,3-dioxane-(4R)-acetate, which was analyzed for diastereopurity by GC/MS prior to crystallization.

To a 100 mL three-neck flask equipped with a PTFE-coated magnetic stirring bar and a pH electrode connected to an automatic titrator for pH-controlled addition of base on-demand via a feeding tube into the flask, was charged 18 mL 100 mM triethanolamine (chloride) buffer, pH 7.0, 12 g crude t-butyl 6-cyano-(5R)-hydroxy-3-oxohexanoate, and 7.99 g glucose. The pH of the solution was readjusted to 7.0 with 0.26 mL 4N NaOH. 1 mL of the same buffer containing 200 mg ketoreductase powder comprising the engineered ketoreductase having the amino acid sequence SEQ ID NO. 316, 15 mg glucose dehydrogenase powder, and 5 mg NaNADP was added and the reaction mixture was stirred at 22° C. The automatic titrator maintained the pH at 6.9 by the addition of 4N NaOH, which was continuously recorded. An additional 15 mg glucose dehydrogenase powder and 1 g glucose were added after 4.6 hours and an additional 15 mg glucose dehydrogenase powder and 1.5 mg NaNADP were added after 7 hours. After a total of 12 hours 9.04 ml 4 N NaOH had been consumed, and an extract of a sample analyzed by the method of Example 4 showed 99.3% conversion. 2.5 g diatomaceous earth was added to the reaction mixture, which was then extracted three times with 50 mL ethyl acetate. The solvent was removed from the combined organic extracts by rotary evaporation under vacuum to obtain 10.40 g crude t-butyl 6-cyano-(3R,5R)-dihydroxyhexanoate as an oil.

To the crude t-butyl 6-cyano-(3R,5R)-dihydroxyhexanoate was added 22 mL 2,2-dimethoxypropane and 100 µL methanesulfonic acid. The mixture was stirred at for 2 hours at room temperature. After addition of 5 mL saturated aqueous sodium bicarbonate, the pH of the aqueous phase was 8.0. The mixture was extracted with 60 mL hexane, and the solvent was removed from the extract by rotary evaporation under vacuum to leave a golden oil comprising t-butyl (6R)-(2-cyanoethyl)-2,2-dimethyl-1,3-dioxane-(4R)-acetate.

A sample of the oil was dissolved in ethyl acetate to 5 mg/mL, which was analyzed by the following GC/MS method:

Column: HP5MS (0.25 mm i d, 25 µm df, 30 m)
Carrier gas: Helium, 9.44 psi, 0.7 mL/minute.
Oven: 50° C. for 1 min, then 30° C./min to 220° C., then hold at 220° C. for 3 min.
Retention Times: (4S,6R) 7.9 min; (4R,6R) 8.0 min.
Detection: single ion monitoring, m/z 198.

The GC/MS analysis showed the t-butyl (6R)-(2-cyanoethyl)-2,2-dimethyl-1,3-dioxane-(4R)-acetate oil to be substantially diastereomerically pure. For comparison a sample of commercially obtained (Aldrich, catalog no. 53, 901-5), crystalline t-butyl (6R)-(2-cyanoethyl)-2,2-dimethyl-1,3-dioxane-(4R)-acetate was dissolved in ethyl acetate to 5 mg/mL, and likewise analyzed, showing 0.10% of the (4S, 6R) diastereomer. FIG. 7 shows the overlapped GC/MS chromatograms of the oil and the crystalline t-butyl (6R)-(2-cyanoethyl)-2,2-dimethyl-1,3-dioxane-(4R)-acetate.

The oil was then dissolved in 17 mL hexane and 50° C., and the solution was cooled to 0° C. for crystallization. Filtration and drying in air yielded 8.1 g crystalline t-butyl (6R)-(2-cyanoethyl)-2,2-dimethyl-1,3-dioxane-(4R)-acetate of 98.7 area % chemical purity.

This example illustrates the process of the invention providing a substantially diastereomerically pure protected syn 3,5-dihydroxyhexanoate compound without any diastereomeric purification, for example, by crystallization.

8.24 Example 24

Preparation of t-butyl (6R)-(2-aminoethyl)-2,2-dimethyl-1,3-dioxane-(4R)-acetate (Formula V)

t-butyl (6R)-(2-cyanoethyl)-2,2-dimethyl-1,3-dioxane-(4R)-acetate, such as prepared in Examples 18 and 23, is converted to the title compound using the methodology disclosed in U.S. Pat. No. 5,003,080 at column 49, lines 16-43, which is incorporated herein by reference. In particular, a solution of t-butyl (6R)-(2-cyanoethyl)-2,2-dimethyl-1,3-dioxane-(4R)-acetate, 5.63 g (0.048 mol), in 100 mL of methanol saturated with gaseous ammonia is treated with 0.5 g of Raney nickel #30 and hydrogen gas in a shaker at 50 psi and 40° C. After 16 hours, thin layer chromatography indicates that no starting nitrile present. The suspension is cooled, filtered through a filter aid, and concentrated to an oil. This crude oil is purified by flash chromatography on silica gel with 30:20:1 (ethyl acetate:methanol:ammonium hydroxide) as eluent to give 4.93 g of the titled compound: t-butyl (6R)-(2-aminoethyl)-2,2-dimethyl-1,3-dioxane-(4R)-acetate of Formula V (98.2 area %), as a clear oil with acceptable IR, NMR, C-NMR and MS spectra.

8.25 Example 25

Preparation of t-butyl (6R)-[2[2-(fluorophenyl)-5-(-(1-methylethyl)-3-phenyl-4-[(phenylamino)carbonyl]-1H-pyrrol-1-yl]ethyl]-2,2-dimethyl-1,3-dioxane-(4R)-acetate (Formula VI)

t-butyl (6R)-(2-aminoethyl)-2,2-dimethyl-1,3-dioxane-(4R)-acetate, such as prepared in Example 24, is converted to the title compound using the methodology disclosed in U.S. Pat. No. 5,003,080 at column 49, lines 43-60, which is incorporated herein by reference. In particular, a solution of t-butyl (6R)-(2-aminoethyl)-2,2-dimethyl-1,3-dioxane-(4R)-acetate (formula IV), 1.36% (4.97 mol), and (±)-4-fluoro-α-[2-methyl-1-oxopropyl]-γ-oxo-N,β-diphenylbenzenebutaneamide (formula V), which is a mixture of [R—(R',R')], [R—(R',S')], [S—(R',R')] and [S—R',S')]isomers, 1.60 g (3.83 mol), in 50 mL of heptane:toluene (9:1) is heated at reflux for 24 hours. The solution is cooled slightly and 15 mL of 2-propanol added. The mixture is allowed to cool to 25° C. and filtered to give 1.86 g of the titled compound: t-butyl (6R)-[2[2-(fluorophenyl)-5-(-(1-methylethyl)-3-phenyl-4-[(phenylamino) carbonyl]-1H-pyrrol-1-yl]ethyl]-2,2-dimethyl-1,3-dioxane-(4R)-acetate of formula VI, as a yellow solid with acceptable NMR spectra.

8.26 Example 26

Preparation of (2R-trans)-5-(4-fluorophenyl)-2-(1-methylethyl)-N,4-diphenyl-1-[2-(tetrahydro-4-hydroxy-6-oxo-2H-pyran-2-yl)ethyl]-1H-pyrrole-3-carboxamide (a.k.a. Atorvastatin Lactone) (Formula VII)

t-butyl (6R)-[2[2-(fluorophenyl)-5-(4-(1-methylethyl)-3-phenyl-4-[(phenylamino)-carbonyl]-1H-pyrrol-1-yl]ethyl]-2,2-dimethyl-1,3-dioxane-(4R)-acetate, such as prepared in Example 25, is converted to the title compound using the methodology disclosed in U.S. Pat. No. 5,003,080 at col. 50, lines 4-30, which is incorporated herein by reference. In particular, 4.37 g (6.68 mol) of t-butyl (6R)-[2[2-(fluorophenyl)-5-(-(1-methylethyl)-3-phenyl-4-[(phenylamino)carbonyl]-1H-pyrrol-1-yl]ethyl]-2,2-dimethyl-1,3-dioxane-(4R)-acetate is dissolved in 200 mL of tetrahydrofuran and 15 mL of 10% hydrochloric acid solution is added, and the solution is stirred for 15 hours. To this solution is added sodium hydroxide (3.6 g) and the mixture is stirred for 30 hours. The reaction is stopped by adding 150 mL of water, 90 mL of hexane, and separating the layers. The aqueous layer is acidified with dilute hydrochloric acid solution, stirred for three hours and extracted with 150 mL of ethyl acetate. A drop of concentrated hydrochloric acid is added to the ethyl acetate solution and the solution is allowed to stand 18 hours. The solution is concentrated in vacuo and the concentrate is redissolved in 50 mL of ethyl acetate and treated with one drop of concentrated hydrochloric acid. The solution is stirred two hours, concentrated in vacuo, and dissolved in 3.0 mL of toluene. The titled compound, (2R-trans-5-(4-fluorophenyl)-2-(1-methyl-ethyl)-N,4-diphenyl-1-[2-(tetrahydro-4-hydroxy-6-oxo-2H-pyran-2-yl)ethyl]-1H-pyrrole-3-carboxamide (3.01 g) of Formula VII, which is also known as atorvastatin lactone, is isolated in two crops.

8.27 Example 27

Preparation of [R—(R*,R*)]-2-(4-fluorophenyl)-β-δ-dihydroxy-5-(1-methylethyl)-3-phenyl-4-[(phenylamino)carbonyl]-1H-pyrrole-1-heptanoic acid, Calcium Salt (2:1) of Formula VIII (2R-trans)-5-(4-fluorophenyl)-2-(1-methylethyl)-N,4-diphenyl-1-[2-(tetrahydro-4-hydroxy-6-oxo-2H-pyran-2-yl)ethyl]-1H-pyrrole-3-carboxamide, such as prepared in Example 26, is converted to the title compound of Formula VIII using the methodology disclosed in Examples 1A or 1B of U.S. Pat. No. 5,969,156, entitled "Crystalline [R—(R*,R*)]-2-(4-fluorophenyl)-β,δ-dihydroxy-5-(1-methylethyl)-3-phenyl-4-[(phenylamino)carbonyl]-1H-pyrrole-1-heptanoic acid hemi calcium salt (atorvastatin)," which issued on Oct. 19, 1999 and which examples are incorporated herein by reference. The title compound is well known under the generic name atorvastatin, hemi calcium salt and the brand name LIPITOR®. Preparation of the calcium salt from the lactone of Example 26 is disclosed in Example 10 of U.S. Pat. No. 5,273,995 which is incorporated herein by reference.

i. Sodium Salt

In particular, dissolve one mole of the lactone (540.6 g) from Example 26 in 5 L of methanol. After dissolution, add 1 L of $H_2O$. While stirring, add 0.98 equivalents NaOH and follow the reaction by HPLC until 2% or less lactone and methyl ester of the diol acid remains. An excess of NaOH is not used because $Ca(OH)_2$ can form upon the addition of $CaCl_2$ in a subsequent step. Upon hydrolysis of the lactone, [R—(R*,R*)]-2-(4-fluorophenyl)-β-δ-dihydroxy-5-(1-methylethyl)-3-phenyl-4-[(phenylamino)carbonyl]-1H-pyrrole-1-heptanoic acid, sodium salt (atorvastatin, sodium salt) is formed.

ii. Calcium Salt

Upon completion of hydrolysis, add 10 L $H_2O$, then wash at least two times with a 1:1 mixture of EtOAc/hexane. Each wash should contain 10 L each of EtOAc/hexane. If sodium salt is pure, add 15 L of methanol. If it is impure and/or contains color, add 100 g of G-60 charcoal, stir for two hours, filter over supercel and then wash with 15 L MeOH. Perform an analysis on the reaction mixture by HPLC to determine the exact amount of the sodium salt of atorvastatin that is in the aqueous methanol solution.

Dissolve 1 equivalent or slight excess of $CaCl_2.2H_2O$ (73.5 g) in 20 L $H_2O$. Heat both the $CaCl_2$ solution and the aqueous methanol solution to 60° C. Add the $CaCl_2$ solution slowly, with high agitation to the 60° C. aqueous methanol solution of atorvastatin, sodium salt. After complete addition, cool the mixture slowly to 15° C. and filter the precipitating calcium salt of formula VIII. Wash the filter cake with 5 L $H_2O$. Dry at 50° C. in a vacuum oven.

The calcium salt from the dried filter cake can be recrystallized by dissolving in 4 L of EtOAc (50° C.), filtering over Supercel®, washing the filtrate with 1 L EtOAc (50° C.), then adding 3 L of a nonpolar solvent such as hexane to the 50° C. EtOAc solution. The resulting crystals of formula VIII are then dried by air or with heating.

8.28 Example 28

Production of Ketoreductases; Fermentation Procedure

In an aerated agitated 15 L fermenter, 6.0 L of growth medium containing 0.88 g/L ammonium sulfate, 0.98 g/L of sodium citrate; 12.5 g/L of dipotassium hydrogen phosphate trihydrate, 6.25 g/L of potassium dihydrogen phosphate, 6.2 g/L of Tastone-154 yeast extract, 0.083 g/L ferric ammonium citrate, and 8.3 ml/L of a trace element solution containing 2 g/L of calcium chloride dihydrate, 2.2 g/L of zinc sulfate septahydrate, 0.5 g/L manganese sulfate monohydrate, 1 g/L cuprous sulfate heptahydrate, 0.1 g/L ammonium molybdate tetrahydrate and 0.02 g/L sodium tetraborate decahydrate was brought to a temperature of 30. The fermenter was inoculated with a late exponential culture of E. coli W3110, containing a plasmid with the ketoreductase gene of interest, grown in a shake flask as described in Example 3 to a starting $OD_{600}$ of 0.5 to 2.0. The fermenter was agitated at 500-1500 rpm and air was supplied to the fermentation vessel at 1.0-15.0 L/min to maintain a dissolved oxygen level of 30% saturation or greater. The pH of the culture was controlled at 7.0 by addition of 20% v/v ammonium hydroxide. Growth of the culture was maintained by the addition of a feed solution containing 500 g/L cerelose, 12 g/L ammonium chloride and 10.4 g/L magnesium sulfate heptahydrate. After the culture reached an $OD_{600}$ of 50, the expression of ketoreductase was induced by the addition of isopropyl-b-D-thiogalactoside (IPTG) to a final concentration of 1 mM. The culture was grown for another 14 hours. The culture was then chilled to 4° C. and maintained at 4° C. until harvested. Cells were harvested by centrifugation at 5000 G for 40 minutes in a Sorval RC12BP centrifuge at 4° C. Harvested cells were used directly in the following downstream recovery process or were stored at 4° C. until such use.

The cell pellet was resuspended in 2 volumes of 100 mM triethanolamine (chloride) buffer, pH 6.8, at 4° C. to each volume of wet cell paste. The intracellular ketoreductase was released from the cells by passing the suspension through a homogenizer fitted with a two-stage homogenizing valve assembly using a pressure of 12000 psig. The cell homogenate was cooled to 4° C. immediately after disruption. A solution of 10% w/v polyethyleneimine, pH 7.2, was added to the lysate to a final concentration of 0.5% w/v and stirred for 30 minutes. The resulting suspension was clarified by centrifugation at 5000 G in a standard laboratory centrifuge for 30 minutes. The clear supernatant was decanted and concentrated ten fold using a cellulose ultrafiltration membrane with a molecular weight cut off of 30 Kd. The final concentrate was dispensed into shallow containers, frozen at −20° C. and lyophilized to powder. The ketoreductase powder was stored at −80° C.

This Example illustrates the production of ketoreductase powders by a practical scaleable procedure.

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (366 sequences)

SEQ ID NO: 1 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 2 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 3 - DNA, 762 bp, Artificial Sequence
  Synthetic Construct
atgtctaaccgtctggatggcaaagtagccatcattaccggcgggactctgggtatcggtttggcaatcgccacgaaatttgtagaggagggtgcgaaagtaatgattactggtcgtcactccgatgtaggtgaaaaggccgccaaatcagtaggcactccggatcagattcagttttttcagcacgattcatccgatgaagatggctggacgaaactgttcgacgccaccgagaaagcattcggcccggttagcaccttagtgaacaatgcagggattgcagttaacaaaagcgttgaagaaactaccacggccgaatggcgtaaactgctggccgttaatctggatggtgtttttttcggcacccgtctgggcattcagcgcatgaaaaataaaggcttgggcgctagcatcatcaatatgagcagtattgaggggttcgtaggcgatccgagcctgggggcatacaacgcttccaagggggcggtacgtatcatgtcgaaaagcgcagcgctggattgcgcactgaaggactacgatgtgcgtgtcaacacagtacatccgggctatatcaagaccccgctggtcgatgatctgccgggtgctgaggaagcgatgtcacagcgtacgaaaacccctatgggccacattggcgaaccgaatgacatcgcatatatctgtgtgtacctggcatctaatgaatcgaaatttgcgacgggttccgaatttgtggtcgacggcgggtataccgcacagtaatga

SEQ ID NO: 4 - protein, 252 aa, Artificial Sequence
  Synthetic Construct
MSNRLDGKVAIITGGTLGIGLAIATKFVEEGAKVMITGRHSDVGEKAAKSVGTPDQIQFFQHDSSDEDGWTKLFDATEKAFGPVSTLVNNAGIAVNKSVEETTTAEWRKLLAVNLDGVFFGTRLGIQRMKNKGLGASIINMSSIEGFVGDPSLGAYNASKGAVRIMSKSAALDCALKDYDVRVNTVHPGYIKTPLVDDLPGAEEAMSQRTKTPMGHIGEPNDIAYICVYLASNESKFATGSEFVVDGGYTAQ

SEQ ID NO: 5 - DNA, 1050 bp, Artificial Sequence
  Synthetic Construct
atgaaagccattcagtacactcgtatcggtgcggaaccagaactgactgaaatcccgaagccggaaccgggcccgggcgaagtactgctggaagtcacggcagctggcgtgtgccattccgatgatttcattatgtctctgccggaagaacagtacacctacggcctgccgctgaccctgggtcatgaaggtgctggtaaagttgccgcagttggcgaaggtgttgaagggttggatattggcaccaatgtggttgtgtacggcccatggggttgtggcaactgttggcattgcagtcagggcctggagaactattgctcccgtgcgcaggaactgggtattaacccgcctggtctgggtgctccgggggctttggcagaatttatgattgtcgactcaccacgtcatttggtcccgattggcgatttagaccctgttaaaactgttccgttgactgatgcgggcctgaccccataccatgcaatcaaacgctccctgccgaaactgcgcggcggctcttatgcagtagtgatcggtacgggtggcctgggccacgtggctatccaactgctgcgtcatttatctgctgcaacggtgatcgccttggacgtttctgccgataaactggaactggctaccaaagtcggcgcacatgaagtagtcctgtctgataaagatgcagcggagaatgtgcgtaaaattactggtagccaaggtgcagctttggtgttggattttgtgggctatcagcctaccattgacaccgccatggcagtggcgggcgtgggctctgacgtcaccattgttggtatcggtgatggccaggcacatgcgaaagttggtttcttccagagtccttatgaggcatcggttacggtaccttattggggcgctcgtaatgaactgatcgaattgatcgatctggcgcatgctggtattttcgacattgccgttgagaccttctctttggataatggtgcagaggcctatcgtcgcctggctgcgggcacactgtcaggccgtgcggtagtcgtcccgggcctgtaatga

SEQ ID NO: 6 - protein, 348 aa, Artificial Sequence
  Synthetic Construct
MKAIQYTRIGAEPELTEIPKPEPGPGEVLLEVTAAGVCHSDDFIMSLPEEQYTYGLPLTLGHEGAGKVAAVGEGVEGLDIGTNVVVYGPWGCGNCWHCSQGLENYCSRAQELGINPPGLGAPGALAEFMIVDSPRHLVPIGDLDPVKTVPLTDAGLTPYHAIKRSLPKLRGGSYAVVIGTGGLGHVAIQLLRHLSAATVIALDVSADKLELATKVGAHEVVLSDKDAAENVRKITGSQGAALVLDFVGYQPTIDTAMAVAGVGSDVTIVGIGDGQAHAKVGFFQSPYEASVTVPYWGARNELIELIDLAHAGIFDIAVETFSLDNGAEAYRRLAAGTLSGRAVVVPGL

SEQ ID NO: 7 - DNA, 1050 bp, Artificial Sequence
  Synthetic Construct
atgaccacggaaaaaaccgtagtgttcgtgtcaggcgcgaccggttttattgctctgcacgtggtagatgacctgctgaaaactggttacaaagtaattggttccggtcgttctcaggaaaaaaatgacggtttgctgaagaagttcaagtccaacccgaatctgagcatggaaattgtggaagatattgcggcaccaaacgccttcgataaagtattccagaaacatggtaaagaaattaaagtggtcctgcatatcgcgtccccggtccatttcaacactaccgatttcgaaaaagacttactgatcccggcggtaaacggtaccaaatctattttggaagcaattaagaactatgccgcagacaccgtggaaaaagtggttattacttcatctgttgccgcgttggcctctccgggtgatatgaaagataccagcttcgtggttaacgaagaatcctggaataaagacacctgggaatcgtgtcaggcgaatgctgtgtccgcttattgcggttctaaaaaattcgcagagaaaacggcgtgggacttcttggaagaaaaccagagcagcattaaatttactctgtccacgattaacccaggcttcgtttttggtccgcagctgttcgccgactccttgcgcaatggtattaactctagcagtgcgattattgcgaacctggtgtcgtataaattaggggataacttctacaattatagcggcccgtttatcgacgtccgtgacgtttccaaagctcatctgctggcatttgagaaacctgaatgcgccggtcagcgcctgtttctgtgcgaggatatgttctgttcccaggaagccctggacattctgaacgaagaatttccacagctgaagggcaagatcgcaacgggcgaacctggcagcggctcgaccttcctgactaaaaattgttgcaaatgcgacaatcgtaaaactaaaaacttgctgggcttccagttcaacaaattccgcgactgcattgtcgatactgcgtcccagttgctggaagtgcaaagcaaaagctaatga

SEQ ID NO: 8 - protein, 348 aa, Artificial Sequence
  Synthetic Construct
MTTEKTVVFVSGATGFIALHVVDDLLKTGYKVIGSGRSQEKNDGLLKKFKSNPNLSMEIVEDIAAPNAFDKVFQKHGKEIKVVLHIASPVHFNTTDFEKDLLIPAVNGTKSILEAIKNYAADTVEKVVITSSVAALASPGDMKDTSFVVNEESWNKDTWESCQANAVSAYCGSKKFAEKTAWDFLEENQSSIKFTLSTINPGFVFGPQLFADSLRNGINSSSAIIANLVSYKLGDNFYNYSGPFIDVRDVSKAHLLAFEKPECAGQRLFLCEDMFCSQEALDILNEEFPQLKGKIATGEPGSGSTFLTKNCCKCDNRKTKNLLGFQFNKFRDCIVDTASQLLEVQSKS

SEQ ID NO: 9 - DNA, 942 bp, Artificial Sequence
  Synthetic Construct
atgccggcaacgttaaaaaacagcagtgctaccttaaaattaaacacaggtgcgagcattcctgtcctggggttcggcacctggcgctctgtcgataacaacggctatcatagtgtaattgcggcgctgaaagcggggtaccgtcatatcgatgctgcggccatctatctgaatgaagaagaagtcggccgtgcgatcaaggactccggtgttcctcgtgaagaaatttttattaccaccaaactgtggggcaccgaacaacgcgatccagaagcagccctgaacaaatctctgaaacgtctgggtctggactatgtggacctgtatctgatgcactggccggtccctctgaaaacagaccgtgtaactgacggtaacgtcctgtgcatcccgaccctggaagatggcaccgtggacatcgataccaaagagtggaattttattaaaacctgggaactgatgcaggaattgccgaaaactggtaagaccaaagccgtcggtgtgtccaatttttccatcaacaatatcaaagaactgctggaatcgccaaataacaaggtcgttccagcaaccaatcagatcgagattcatccgttgctgccgcaggatgaattaatcgccttttgtaaagaaaaaggcattgtggtcgaagcatatagcccattcggctccgctaacgccccgctgctgaaagaacaggcgattatcgatatggccaaaaagcacggcgtcgaaccggcgcaactgattatcagctggtcgattcagcgcggttatgtggtattggccaagtccgtaaatccggagcgtatcgtgtcgaactttaagatttttaccctgccagaggatgatttcaaaaccatctctaacctgagcaaagtgcacggtaccaaacgtgtcgttgacatgaaatggggctcatttccgatttttcaataatga

SEQ ID NO: 10 - protein, 312 aa, Artificial Sequence
  Synthetic Construct
MPATLKNSSATLKLNTGASIPVLGFGTWRSVDNNGYHSVIAALKAGYRHIDAAAIYLNEEEVGRAIKDSGVPREEIFITTKLWGTEQRDPEAALNKSLKRLGLDYVDLYLMHWPVPLKTDRVTDGNVLCIPTLEDGTVDIDTKEWNFIKTWELMQELPKTGKTKAVGVSNFSINNIKELLESPNNKVVPATNQIEIHPLLPQDELIAFCKEKGIVVEAYSPFGSANAPLLKEQAIIDMAKKHGVEPAQLIISWSIQRGYVVLAKSVNPERIVSNFKIFTLPEDDFKTISNLSKVHGTKRVVDMKWGSFPIFQ

SEQ ID NO: 11 - DNA, 1032 bp, Artificial Sequence
  Synthetic Construct
atgtctgtgttcgtgtcaggcgcgaatggttttattgctcagcacatcgtagatctgctgctgaaagaagattacaaagtaattggttccgcacgttctcaggaaaaagctgaaaatttgaccgaagccttcggtaacaacccgaaatttagcatggaagtggtgcctgatattagcaaactggatgccttcgatcatgtattccagaaacatggtaaagatattaaaatcgtcctgcataccgcgtccccgttttgtttcgatattaccgattccgaacgtgacttactgatcccggcggtaaacggtgtcaaaggtattttgcacagtattaagaaatatgccgcagacagcgtggaacgcgtggttctgacttcatcttacgccgcggtatttgatatggcgaaggaaaacgataagagcctgaccttcaacgaagaatcctggaatccggcgacctgggaatcgtgtcagagtgatccggtgaacgcttattgcggttctaaaaaattcgcagagaaagcagcgtgggaattcttggaagaaaaccgtgatagcgtgaaatttgagctgacagcggtcaacccagtttacgtttttggtccgcagatgttcgataaagatgttaaaaaacacttgaacaccagctgcgaactggtgaactctctgatgcatctgagccctgaagataaaattccggaactgtttggcggttacatcgacgtccgtgacgttgcgaaagctcatctggttgcatttcagaaacgtgaaacaatcggtcagcgcctgatcgtgtcggaggcacgtttcacgatgcaggacgttctggacattctgaacgaagactttccagtactgaagggcaatatcccggtcggcaagcctggcagcggcgccacccataatactctgggcgccaccctggacaataaaaaaagcaaaaaattgctgggcttcaaattccgtaatctgaaagagactattgacgatactgcgtcccagatcctgaaattcgaaggtcgcatttaatga

SEQ ID NO: 12 - protein, 342 aa, Artificial Sequence
  Synthetic Construct
MSVFVSGANGFIAQHIVDLLLKEDYKVIGSARSQEKAENLTEAFGNNPKFSMEVVPDISKLDAFDHVFQKHGKDIKIVLHTASPFCFDITDSERDLLIPAVNGVKGILHSIKKYAADSVERVVLTSSYAAVFDMAKENDKSLTFNEESWNPATWESCQSDPVNAYCGSKKFAEKAAWEFLEENRDSVKFELTAVNPVYVFGPQMFDKDVKKHLNTSCELVNSLMHLSPEDKIPELFGGYIDVRDVAKAHLVAFQKRETIGQRLIVSEARFTMQDVLDILNEDFPVLKGNIPVGKPGSGATHNTLGATLDNKKSKKLLGFKFRNLKETIDDTASQILKFEGRI

SEQ ID NO: 13 - DNA, 759 bp, Artificial Sequence
  Synthetic Construct
atgaccgatcgtctgaagggcaaagtagccatcgtaaccggcgggactctgggtatcggtttggcaatcgccgataaatttgtagaggagggtgcgaaagtagttattactggtcgtcacgcggatgtaggtgaaaaggccgccaaatcaatcggcggcactgatgttattcgctttgtccagcacgatgcatccgatgaagcaggctggacgaaactgttcgacaccaccgaggaggcattcggcccggttacgaccgtcgtgaacaatgcagggattgcagtttccaaaagcgttgaagacactaccacggaggaatggcgtaaactgctgtccgttaatctggatggtgtttttttcggcacccgtctgggcattcagcgcatgaaaaataaaggcttgggcgctagcatcatcaatatgagcagtattgaggggttcgtaggcgatccgacgctgggggcatacaacgcttccaagggggcggtacgtatcatgtcgaaaagcgcagcgctggattgcgcactgaaggactacgatgtgcgtgtcaacacagtacatccgggctatatcaagaccccgctggtcgatgatctggaaggtgctgaggaaatgatgtcacagcgtacgaaaacccctatgggccacattggcgaaccgaatgacatcgcatggatctgtgtgtacctggcatctgacgaatcgaaatttgcgacgggtgcagaatttgtggtcgacggcgggtataccgcacagtga

SEQ ID NO: 14 - protein, 252 aa, Artificial Sequence
  Synthetic Construct
MTDRLKGKVAIVTGGTLGIGLAIADKFVEEGAKVVITGRHADVGEKAAKSIGGTDVIRFVQHDASDEAGWTKLFDTTEEAFGPVTTVVNNAGIAVSKSVEDTTTEEWRKLLSVNLDGVFFGTRLGIQRMKNKGLGASIINMSSIEGFVGDPTLGAYNASKGAVRIMSKSAALDCALKDYDVRVNTVHPGYIKTPLVDDLEGAEEMMSQRTKTPMGHIGEPNDIAWICVYLASDESKFATGAEFVVDGGYTAQ

SEQ ID NO: 15 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtacgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatatagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 16 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDIALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 17 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgcgtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagtcaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 18 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMRTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 19 - DNA, 942 bp, Artificial Sequence
  Synthetic Construct
atgtcttttcatcaacagtttttcacgctgaataacggcaataaaatcccggcgattgccatcatcggcactggtacacgttggtataaaaatgaagaaactgacgcgaccttctccaatagtctggttgatcaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtaccgattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactccgccgcccagaaagtgtaatga

SEQ ID NO: 20 - protein, 312 aa, Artificial Sequence
  Synthetic Construct
MSFHQQFFTLNNGNKIPAIAIIGTGTRWYKNEETDATFSNSLVDQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNSAAQKV

SEQ ID NO: 21 - DNA, 942 bp, Artificial Sequence
  Synthetic Construct
atgtcttttcaccaacagtttttcacgctgaacaacggcaataaaatcccggcgattgccatcatgggcactggtacacgttggtataaaaatgaagaaactgacgcgaccttctccaatagtctggttgagcaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatataaaactggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 22 - protein, 312 aa, Artificial Sequence
  Synthetic Construct
MSFHQQFFTLNNGNKIPAIAIMGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKTGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 23 - DNA, 939 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggatcatgaaccgctgcgcctgtactggaataaattgtatggcaaatataactacgccgcccagaaagtgtaa

SEQ ID NO: 24 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLDHEPLRLYWNKLYGKYNYAAQKV

SEQ ID NO: 25 - DNA, 942 bp, Artificial Sequence
  Synthetic Construct
atgtcttttcaccaacagtttttcacgctgaacaacggcaataaaatcccggcgattgccatcatcggcactggtacagcttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 26 - protein, 312 aa, Artificial Sequence
  Synthetic Construct
MSFHQQFFTLNNGNKIPAIAIIGTGTAWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 27 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgagcaaatcgtgtatgcgttgaaactgccggggattatccacatcgacgccgcggagatctatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgcgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataacaacgccgcccagaaagtgtaatga

SEQ ID NO: 28 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGALPVTTSSKPQRISDAQNLFSFDLTAEEVDKITELGLEHEPLRLYWNKLYGKYNNAAQKV

SEQ ID NO: 29 - DNA, 942 bp, Artificial Sequence
  Synthetic Construct
atgtcttttcaccaacagtttttcacgctgaacaacggcaataaaatcccggcgattgccatcatcggcactggtacagcttggtacaaaaatgaagaaactgacgcgaccttctccaatagtctggttgaacaaatcgtgcatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 30 - protein, 312 aa, Artificial Sequence
  Synthetic Construct
MSFHQQFFTLNNGNKIPAIAIIGTGTAWYKNEETDATFSNSLVEQIVHALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 31 - DNA, 936 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacaccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtg

SEQ ID NO: 32 - protein, 312 aa, Artificial Sequence
  Synthetic Construct
MSFHQQFFTLNNGNKIPAIAIIGTGTRWYKNEETDATFSNSLVEQIVYALKLPGIIHIDTAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 33 - DNA, 936 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacaggttatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtg

SEQ ID NO: 34 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTGYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 35 - DNA, 936 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaagtcaaccagattgagttctctccgctcctgcaaaaccaaacaccaggtatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtg

SEQ ID NO: 36 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPLLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 37 - DNA, 936 bp, Artificial Sequence
  Synthetic Construct
atgtcttttcaccaacagtttttcacgctgaacaacggcaataaaatcccggcgattgccatcatcggcactggtacacgttggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtg

SEQ ID NO: 38 - protein, 312 aa, Artificial Sequence
  Synthetic Construct
MSFHQQFFTLNNGNKIPAIAIIGTGTRWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 39 - DNA, 936 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggagcatgaaccgctgcgcgtgtactggaataaattgtatggcaaatataactacgccgcccagaaagtg

SEQ ID NO: 40 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRVYWNKLYGKYNYAAQKV

SEQ ID NO: 41 - DNA, 936 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccaaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcttgtactggaataaattgtatggcaaatataactacgccgcccagaaagtg

SEQ ID NO: 42 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTKKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 43 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctcctatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatactctccgctgggcccgctgcagaagaaaaccgcgcaggatgacagccaaccattttttgagtacgtcaaagaattgtgcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 44 - protein, 312 aa, Artificial Sequence
  Synthetic Construct
MSFHQQFFTLNNGNKIPAIAIIGTGTRWYKNEETDATFSYSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELCEKYIKSEAQIILRWVTKRGVLPVTTSSKPQRISDAQNLFSFDLTAEEVDKITELGLEHEPLRLYWNKLYGKYNYAAQKV

SEQ ID NO: 45 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcataagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagttgggtctggaacatgaaccgctgcgcctgtactggaataaattgtatggcaaatataactacgccgcccagaaagtgtaatga

SEQ ID NO: 46 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLHKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 47 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctggatcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 48 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWITKRGVLPVTTSSKPQRISDAQNLFSFDLTAEEVDKITELGLEHEPLRLYWNKLYGKYNYAAQKV

SEQ ID NO: 49 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcgcagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgatcctgcaaaaccaaactccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 50 - protein, 312 aa, Artificial Sequence
  Synthetic Construct
MSFHQQFFTLNNGNKIPAIAIIGTGTRWYKNEETDATFSNSLVEQIVYALKLPGIIHIDAAQIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPILQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 51 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacaccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccattcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 52 - protein, 312 aa, Artificial Sequence; identical to SEQ ID NO: 32
  Synthetic Construct

SEQ ID NO: 53 - DNA, 942 bp, Artificial Sequence
  Synthetic Construct
atgtcttttcaccaacagtttttcacgctgaacaacggcaataaaatcccggcgattgccatcatcggcactggtacagcttggtacaaaaatgaagaaactgacgcgaccttctccaatagtctggttgaacaaatcgtgcatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgccaggagcacgatatcctggtggaagcatattctccgctgggcccgctgcagaagaaaaccgcgcaggatgacagtcaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 54 - protein, 312 aa, Artificial Sequence
  Synthetic Construct
MSFHQQFFTLNNGNKIPAIAIIGTGTAWYKNEETDATFSNSLVEQIVHALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 55 - DNA, 942 bp, Artificial Sequence
  Synthetic Construct
atgtcttttcaccaacagtttttcacgctgaacaacggcaataaaatcccggcgattgccatcatgggcactggtacacgttggtataaaaatgaagaaactgacgcgaccttctccaatagcctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgtggacggtctggatttagcattgaagaaaatgcgtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagtcaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactccgccgcccagaaagtgtaatga

SEQ ID NO: 56 - protein, 312 aa, Artificial Sequence
  Synthetic Construct
MSFHQQFFTLNNGNKIPAIAIMGTGTRWYKNEETDATFSNSLVEQIVYALKLPGIIHIDAAEIYRTYPEVGKALSLTEKPRNAIFLTDKYSPQIKMSDSPVDGLDLALKKMRTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNSAAQKV

SEQ ID NO: 57 - DNA, 942 bp, Artificial Sequence
  Synthetic Construct
atgtcttttcatcaacagttcttcacgctgaataacggcaataaaatcccggcgattgccatcatcggcactggtacagcttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactccgccgcccagaaagtgtaatga

SEQ ID NO: 58 - protein, 312 aa, Artificial Sequence
  Synthetic Construct
MSFHQQFFTLNNGNKIPAIAIIGTGTAWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNSAAQKV

SEQ ID NO: 59 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttggaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatataaaactggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 60 - protein, 312 aa, Artificial Sequence
  Synthetic Construct
MSFHQQFFTLNNGNKIPAIAIIGTGTKWYKNEETDATFSNSLVEQIVYALELPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKTGKAKNIGVSNFAVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 61 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacaccgcggagatttatcgcacctacccggaagtgggtaaagcactgtccctgaccgaaaagcctcgtaacgcgatttttctgacggataaatattctccgcagattaaaatgagtgactcccctgcgggcggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttctccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 62 - protein, 312 aa, Artificial Sequence
  Synthetic Construct
MSFHQQFFTLNNGNKIPAIAIIGTGTRWYKNEETDATFSNSLVEQIVYALKLPGIIHIDTAEIYRTYPEVGKALSLTEKPRNAIFLTDKYSPQIKMSDSPAGGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 63 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagatcgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 64 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 65 - DNA, 942 bp, Artificial Sequence
  Synthetic Construct
atgtcttttcaccaacagtttttcacgctgaacaacggcaataaaatcccggcgattgccatcatcggcactggtacagcttggtacaaaaatgaagaaactgacgcgaccttctccaatagtctggttgaacaaatcgtgcatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagtcaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 66 - protein, 312 aa, Artificial Sequence; identical to SEQ ID NO: 54
  Synthetic Construct

SEQ ID NO: 67 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgagcaaatcgtgtatgcgttgaaactaccggggattatccacatcgacaccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagatcgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 68 - protein, 312 aa, Artificial Sequence
  Synthetic Construct
MSFHQQFFTLNNGNKIPAIAIIGTGTRWYKNEETDATFSNSLVEQIVYALKLPGIIHIDTAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 69 - DNA, 942 bp, Artificial Sequence
  Synthetic Construct
atgtcttttcaccaacagtttttcacgctgaacaacggcaataaaatcccggcgattgccatcatgggcactggtacacgttggtataaaaatgaagaaactgacgcgaccttctccaatagtctggttgagcaaatcgtgtatgcgttgaaactgccggggattatccacatcgacaccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaacggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtacggcaaatataactacgccgcccagaaagtgtaatga

SEQ ID NO: 70 - protein, 312 aa, Artificial Sequence
  Synthetic Construct
MSFHQQFFTLNNGNKIPAIAIMGTGTRWYKNEETDATFSNSLVEQIVYALKLPGIIHIDTAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 71 - DNA, 942 bp, Artificial Sequence
  Synthetic Construct
atgtcttttcaccaacagtttttcacgctgaacaacggcaataaaatcccggcgattgccatcatcggcactggtacagcttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcacaggatgacagtcaaccattttttgagtacgtcaaagaattgagcgaaaaatacatcaaatccgaggcccagatcatcctgcgctgggtcactaaacgcggtgtgctgccagttaccacctcttcaaggccccagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 72 - protein, 312 aa, Artificial Sequence
  Synthetic Construct
MSFHQQFFTLNNGNKIPAIAIIGTGTAWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSRPQRISDAQNLFSFDLTAEEVDKITELGLEHEPLRLYWNKLYGKYNYAAQKV

SEQ ID NO: 73 - DNA, 942 bp, Artificial Sequence
  Synthetic Construct
atgtcttttcaccaacagtttttcacgctgaacaacggcaataaaatcccggcgattgccatcatgggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgcgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 74 - protein, 312 aa, Artificial Sequence
  Synthetic Construct
MSFHQQFFTLNNGNKIPAIAIMGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYNKSEAQIILRWVTKRGALPVTTSSKPQRISDAQNLFSFDLTAEEVDKITELGLEHEPLRLYWNKLYGKYNYAAQKV

SEQ ID NO: 75 - DNA, 942 bp, Artificial Sequence
  Synthetic Construct
atgtcttttcaccaacagtttttcacgctgaacaacggcaataaaatcccggcgattgccatcatgggcactggtacacgttggtataaaaatgaagaaactgacgcgaccttctccaatagtctggttgatcaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagatcgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctgcaacatgaaccgctgcgcctgtactggaataaattgtatggcaaatataactacgccgcccagaaagtgtaatga

SEQ ID NO: 76 - protein, 312 aa, Artificial Sequence
  Synthetic Construct
MSFHQQFFTLNNGNKIPAIAIMGTGTRWYKNEETDATFSNSLVDQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLQHEPLRLYWNKLYGKYNYAAQKV

SEQ ID NO: 77 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagtcaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggatcatgaaccgctgcgcctgtactggaataaattgtatggcaaatataactacgccgcccagaaagtgtaatga

SEQ ID NO: 78 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLDHEPLRLYWNKLYGKYNYAAQKV

SEQ ID NO: 79 - DNA, 942 bp, Artificial Sequence
  Synthetic Construct
atgtcttttcaccaacagtttttcacgctgaacaacggcaataaaatcccggcgattgccatcatgggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggatcatgaaccgctgcgcctgtactggaataaattgtatggcaaatataactacgccgcccagaaagtgtaatga

SEQ ID NO: 80 - protein, 312 aa, Artificial Sequence
  Synthetic Construct
MSFHQQFFTLNNGNKIPAIAIMGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLDHEPLRLYWNKLYGKYNYAAQKV

SEQ ID NO: 81 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgcgtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactccgccgcccagaaagtgtaatga

SEQ ID NO: 82 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMRTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNSAAQKV

SEQ ID NO: 83 - DNA, 942 bp, Artificial Sequence
  Synthetic Construct
atgtcttttcaccaacagtttttcacgctgaacaacggcaataaaatcccggcgattgccatcatgggcactggtacacgttggtataaaaatgaagaaactgacgcgaccttctccaatagtctggttgagcaaatcgtgtatgcgttgaaactgccggggattatccacatcgacgccgcggagatttatcgcacctacccggaagtgggtaaagcactgtccctggccgaaaagcctcgtaacgcgatttttctgacggataaatattctccgcagattaaaatgagtgactcccctgcggacggtctggatttagcattgaagaaaatgcgtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagtcaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 84 - protein, 312 aa, Artificial Sequence
  Synthetic Construct
MSFHQQFFTLNNGNKIPAIAIMGTGTRWYKNEETDATFSNSLVEQIVYALKLPGIIHIDAAEIYRTYPEVGKALSLAEKPRNAIFLTDKYSPQIKMSDSPADGLDLALKKMRTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 85 - DNA, 942 bp, Artificial Sequence
  Synthetic Construct
atgtcttttcaccaacagtttttcacgctgaacaacggcaataaaatcccggcgattgccatcatgggcactggtacacgttggtataaaaatgaagaaactgacgcgaccttctccaatagtctggttgagcaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaagatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcgtattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 86 - protein, 312 aa, Artificial Sequence
  Synthetic Construct
MSFHQQFFTLNNGNKIPAIAIMGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 87 - DNA, 942 bp, Artificial Sequence
  Synthetic Construct
atgtcttttcaccaacagtttttcacgctgaacaacggcaataaaatcccggcgattgccatcatcggcactggtacacgttggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagatcgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 88 - protein, 312 aa, Artificial Sequence
  Synthetic Construct
MSFHQQFFTLNNGNKIPAIAIIGTGTRWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 89 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacaccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaccaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 90 - protein, 312 aa, Artificial Sequence
  Synthetic Construct
MSFHQQFFTLNNGNKIPAIAIIGTGTRWYKNEETDATFSNSLVEQIVYALKLPGIIHIDTAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYTKSEAQIILRWVTKRGVLPVTTSSKPQRISDAQNLFSFDLTAEEVDKITELGLEHEPLRLYWNKLYGKYNYAAQKV

SEQ ID NO: 91 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagtcaaccattttttgagtacgtcaaagaattgagcgaaaaatacatcaaatccgaggcccagatcatcctgcgctgggtcactaaacgcggtgtgctgccagttaccacctcttcaaagccccagcgcattagcgatgctcagaacctgttttccttcgacctgacagcggaagaggttgataaaatcacggagctgggtctggaacatgaaccgctgcgcctgtactggaataaattgtatggcaaatataactccgccgcccagaaagtgtgatga

SEQ ID NO: 92 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNSAAQKV

SEQ ID NO: 93 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaggtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacagaagtggtaaagctaaaaacatcggggtttccaatttcacagtggaagacctgcaacgtatcctgaaagtcgctgaagttaagcctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgagccgctgcgcctgtactggaataaattgtatggcaaatataactccgccgcccagaaagtgtaatga

SEQ ID NO: 94 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYRSGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNSAAQKV

SEQ ID NO: 95 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 96 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 97 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaggcctcggaacgcgatttttctgacggataaatattctccgcagattaaaatgagtgactcccctgcggacggtctggatttagcattgaagaaaatgggtaccgattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagtcaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 98 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTERPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 99 - DNA, 942 bp, Artificial Sequence
  Synthetic Construct
atgtcttttcaccaacagtttttcacgctgaacaacggcaataaaatcccggcgattgccatcatcggcactggtacagcttggtacaaaaatgaagaaactgacgcgaccttctccaatagtctggttgagcaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgcgtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 100 - protein, 312 aa, Artificial Sequence
  Synthetic Construct
MSFHQQFFTLNNGNKIPAIAIIGTGTAWYKNEETDATFSNSLVEQIVYALKLPGIIHIDAAEIYRTYPEVGKALSLTEKPRNAIFLTDKYSPQIKMSDSPADGLDLALKKMRTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 101 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacaccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaaccccaggtcaaccagattgagttctctccgttcctgcaaaaccaaacaccaggcatttatagattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 102 - protein, 312 aa, Artificial Sequence
  Synthetic Construct
MSFHQQFFTLNNGNKIPAIAIIGTGTRWYKNEETDATFSNSLVEQIVYALKLPGIIHIDTAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYRFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 103 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcactgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 104 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 105 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggaggtttatcgcacctacccggaagtgggtaaagcactgtccctgaccaaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgttgggcccgctgcggaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcttgtactggaataaattgtatggcaaatataactacgccgcccagaaagtgtaatga

SEQ ID NO: 106 - protein, 312 aa, Artificial Sequence
  Synthetic Construct
MSFHQQFFTLNNGNKIPAIAIIGTGTRWYKNEETDATFSNSLVEQIVYALKLPGIIHIDAAEVYRTYPEVGKALSLTKKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 107 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttggaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaagcctcaggtcaaccagattgagttctctccgttcctgcaaaaccaaacaccaggcatttgtaaattctgtcaggagcacgatatcctggtggaagcatattctccgctgggcccgctgcagaagaaaaccgcgcaggatgacagccaaccattttttgagtacgtcaaagaattgagcgaaaaatacatcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 108 - protein, 312 aa, Artificial Sequence
  Synthetic Construct
MSFHQQFFTLNNGNKIPAIAIIGTGTRWYKNEETDATFSNSLVEQIVYALELPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGICKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 109 - DNA, 942 bp, Artificial Sequence
  Synthetic Construct
atgtcttttcaccaacagtttttcacgctgaacaacggcaataaaatcccggcgattgccatcatcggcactggtacacgttggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcgcagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaccaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 110 - protein, 312 aa, Artificial Sequence
  Synthetic Construct
MSFHQQFFTLNNGNKIPAIAIIGTGTRWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYTKSEAQIILRWVTKRGVLPVTTSSKPQRISDAQNLFSFDLTAEEVDKITELGLEHEPLRLYWNKLYGKYNYAAQKV

SEQ ID NO: 111 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 112 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 113 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgggcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 114 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELGEKYNKSEAQIILRWVTKRGVLPVTTSSKPQRISDAQNLFSFDLTAEEVDKITELGLEHEPLRLYWNKLYGKYNYAAQKV

SEQ ID NO: 115 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgatgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacaaattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctggatcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 116 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTNYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWITKRGVLPVTTSSKPQRISDAQNLFSFDLTAEEVDKITELGLEHEPLRLYWNKLYGKYNYAAQKV

SEQ ID NO: 117 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcttattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgcgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 118 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWVTKRGALPVTTSSKPQRISDAQNLFSFDLTAEEVDKITELGLEHEPLRLYWNKLYGKYNYAAQKV

SEQ ID NO: 119 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctgtttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 120 - protein, 312 aa, Artificial Sequence
  Synthetic Construct
MSFHQQFFTLNNGNKIPAIAIIGTGTKWYKNEETDATFSNSLFEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 121 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacatcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 122 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYIKELSEKYNKSEAQIILRWVTKRGVLPVTTSSKPQRISDAQNLFSFDLTAEEVDKITELGLEHEPLRLYWNKLYGKYNYAAQKV

SEQ ID NO: 123 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctattacattccccgcttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgccaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgatctgacagcggaagaggttgataaaatcacggagctgggtctggaacatgaaccgctgcgcctgtactggaataaattgtatggcaaatataactacgccgcccagaaagtgtaatga

SEQ ID NO: 124 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPLVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 125 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgagaagcctcgtaacgcgatttttctgacggataaatattctccgcagattaaaatgagtgactcccctgcggacggtctggatttagcattgaagaaaatgggtacagattatgttgatttatatctgatacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 126 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 127 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccactgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaatgcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 128 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSMPQRISDAQNLFSFDLTAEEVDKITELGLEHEPLRLYWNKLYGKYNYAAQKV

SEQ ID NO: 129 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttctcggtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaataccggaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 130 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFSVEDLQRILKVAEVKPQVNQIEFSPFLQNQTPGIYKFCQEHDILVEAYSPLGPLQKKTAQDDSQPFFEYVKELSEKYRKSEAQIILRWVTKRGVLPVTTSSKPQRISDAQNLFSFDLTAEEVDKITELGLEHEPLRLYWNKLYGKYNYAAQKV

SEQ ID NO: 131 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttctccgtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacggcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 132 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFSVEDLQRILKVAEVKPQVNQIEFSPFLQNQTPGIYKFCQEHDILVEAYSPLGPLQKKTAQDDSQPFFEYVKELSEKYGKSEAQIILRWVTKRGVLPVTTSSKPQRISDAQNLFSFDLTAEEVDKITELGLEHEPLRLYWNKLYGKYNYAAQKV

SEQ ID NO: 133 - DNA, 942 bp, Artificial Sequence
  Synthetic Construct
atgtcttttcaccaacagtttttcacgctgaacaacggcaataaaatcccggcgattgccatcatcggcactggtacacgttggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcagcgtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaataccaaaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 134 - protein, 312 aa, Artificial Sequence
  Synthetic Construct
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFSVEDLQRILKVAEVKPQVNQIEFSPFLQNQTPGIYKFCQEHDILVEAYSPLGPLQKKTAQDDSQPFFEYVKELSEKYQKSEAQIILRWVTKRGVLPVTTSSKPQRISDAQNLFSFDLTAEEVDKITELGLEHEPLRLYWNKLYGKYNYAAQKV

SEQ ID NO: 135 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccatgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 136 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSMTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 137 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatatatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaacgtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 138 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKRGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 139 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaaaccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 140 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYNKTEAQIILRWVTKRGVLPVTTSSKPQRISDAQNLFSFDLTAEEVDKITELGLEHEPLRLYWNKLYGKYNYAAQKV

SEQ ID NO: 141 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggatggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagacacccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 142 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDRHPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 143 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaacagtctggttgaacaaatcttgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgtcagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 144 - protein, 312 aa, Artificial Sequence
  Synthetic Construct
MSFHQQFFTLNNGNKIPAIAIIGTGTKWYKNEETDATFSNSLVEQILYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDVSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 145 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcagaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgccagtactggaataaattgtatggcaaatataactacgccgcccagaaagtgtaatga

SEQ ID NO: 146 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLQKKTAQDDSQPFFEYVKELSEKYNKSEAQIILRWVTKRGVLPVTTSSKPQRISDAQNLFSFDLTAEEVDKITELGLEHEPLRQYWNKLYGKYNYAAQKV

SEQ ID NO: 147 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttctccgtggaagacctgcaacgtatcctgaaagtcgctgaagttaaaccccaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 148 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFSVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 149 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgagcaaatcgtgcatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 150 - protein, 312 aa, Artificial Sequence
  Synthetic Construct
MSFHQQFFTLNNGNKIPAIAIIGTGTKWYKNEETDATFSNSLVEQIVHALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 151 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtacgcgttggagctgccgggaattatccacatcgacgccgcggaggtttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacggcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 152 - protein, 312 aa, Artificial Sequence
  Synthetic Construct
MSFHQQFFTLNNGNKIPAIAIIGTGTKWYKNEETDATFSNSLVEQIVYALELPGIIHIDAAEVYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYGKSEAQIILRWVTKRGVLPVTTSSKPQRISDAQNLFSFDLTAEEVDKITELGLEHEPLRLYWNKLYGKYNYAAQKV

SEQ ID NO: 153 - DNA, 942 bp, Artificial Sequence
  Synthetic Construct
atgtcttttcaccaacagtttttcacgctgaacaacggcaataaaatcccggcgattgccatcatcggcactggtacaaagtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacgccaggcatttataaattctgtcaggagcacgatatcctggtggaagcatactctccgctgggcccgctgcggatgaaaaccgcgcaggatgacagccaaccattttttgagtacgtcaaagagttgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 154 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRMKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 155 - DNA, 942 bp, Artificial Sequence
  Synthetic Construct
atgtcttttcaccaacagtttttcacgctgaacaacggcaataaaatcccggcgattgccatcatcggcactggtacagcctggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagctcgatatcctggtggaagcatattctccgctgggcccgctgcgggagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 156 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQELDILVEAYSPLGPLREKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 157 - DNA, 942 bp, Artificial Sequence
  Synthetic Construct
atgtcttttcaccaacagtttttcacgctgaacaacggcaataaaatcccggcgattgccatcatcggcactggtacagcctggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagaataatga

SEQ ID NO: 158 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKE

SEQ ID NO: 159 - DNA, 942 bp, Artificial Sequence
  Synthetic Construct
atgtcttttcaccaacagtttttcacgctgaacaacggcaataaaatcccggcgattgccatcatcggcactggtacaaaatggtataaaagtgaagaaactgacgcgaccttctccaatagtctggttgagcaaatcgtgtatgcgttgaaactgccggggattatccacgtcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcgttagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 160 - protein, 312 aa, Artificial Sequence
  Synthetic Construct
MSFHQQFFTLNNGNKIPAIAIIGTGTKWYKSEETDATFSNSLVEQIVYALKLPGIIHVDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRVSDAQNLFSFDLTAEEVDKITELGLEHEPLRLYWNKLYGKYNYAAQKV

SEQ ID NO: 161 - DNA, 942 bp, Artificial Sequence
  Synthetic Construct
atgtcttttcaccaacagtttttcacgctgaacaacggcaataaaatcccggcgattgccatcatcggcactggtacagcctggtataaaagtgaagaaactgacgcgaccttctccaatagtctggttgaacaaatcgtgcatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 162 - protein, 312 aa, Artificial Sequence
  Synthetic Construct
MSFHQQFFTLNNGNKIPAIAIIGTGTAWYKSEETDATFSNSLVEQIVHALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 163 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccagacatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactgaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 164 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPDIYKFCQEHDILVEAYSPLGPLRKKTAQDDSQPFFEYVKELSEKYNKSEAQIILRWVTERGVLPVTTSSKPQRISDAQNLFSFDLTAEEVDKITELGLEHEPLRLYWNKLYGKYNYAAQKV

SEQ ID NO: 165 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggaggtttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgcttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 166 - protein, 312 aa, Artificial Sequence
  Synthetic Construct
MSFHQQFFTLNNGNKIPAIAIIGTGTKWYKNEETDATFSNSLVEQIVYALKLPGIIHIDAAEVYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 167 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctagaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 168 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKARNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 169 - DNA, 942 bp, Artificial Sequence
  Synthetic Construct
atgtcttttcaccaacagtttttcacgctgaacaacggcaataaaatcccggcgattgccatcatcggcactggtacagcctggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 170 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 171 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacagtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgcctgttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 172 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADSLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 173 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacaccgcggagatttatcgcacctacccggaagtgggtaaagcactgtccctgaccgaaaagcctcgtaacgcggtttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 174 - protein, 312 aa, Artificial Sequence
  Synthetic Construct
MSFHQQFFTLNNGNKIPAIAIIGTGTKWYKNEETDATFSNSLVEQIVYALKLPGIIHIDTAEIYRTYPEVGKALSLTEKPRNAVFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 175 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaataccgcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactctgccgcccagaaagtgtaatga

SEQ ID NO: 176 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYRKSEAQIILRWVTKRGVLPVTTSSKPQRISDAQNLFSFDLTAEEVDKITELGLEHEPLRLYWNKLYGKYNSAAQKV

SEQ ID NO: 177 - DNA, 942 bp, Artificial Sequence
  Synthetic Construct
atgtcttttcaccaacagtttttcacgctgaacaacggcaataaaatcccggcgattgccatcatcggcactggtacagcctggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgcttgtttcgaaggaagtgaatggcttaagcttagaagaggcttggaaagatatggagcagttatacaaaagtggtaaagctaaaaacatcggggtttccaatttcacagtggaagacctgcaacgtatcctgagagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 178 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPLVSKEVNGLSLEEAWKDMEQLYKSGKAKNIGVSNFTVEDLQRILRVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 179 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcggttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 180 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMERLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 181 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacgacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 182 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYDKSEAQIILRWVTKRGVLPVTTSSKPQRISDAQNLFSFDLTAEEVDKITELGLEHEPLRLYWNKLYGKYNYAAQKV

SEQ ID NO: 183 - DNA, 942 bp, Artificial Sequence
  Synthetic Construct
atgtcttttcaccaacagtttttcacgctgaacaacggcaataaaatcccggcgattgccatcatcggcactggtacaaaatggtataaaagtgaagaaactgacgcgaccttctccaatagtctggttgaacaaatcgtgtatgcgttgaaactgccggggattatccacattgacgccgcggagatttatcgcacctacccggaagtgggtaaggcactgtccctgaccgaaaagcctcgtaacgcgatttttctgacggataaatattccccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactctgccgcccagaaagtgtaatga

SEQ ID NO: 184 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNSAAQKV

SEQ ID NO: 185 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 186 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 187 - DNA, 942 bp, Artificial Sequence
  Synthetic Construct
atgtcttttcaccaacagtttttcacgctgaacaacggcaataaaatcccggcgattgccatcatcggcactggtacaaaatggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccaaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaagccgcgcaggatgacggccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 188 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTKKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKAAQDDGQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 189 - DNA, 942 bp, Artificial Sequence
  Synthetic Construct
atgtcttttcaccaacagtttttcacgctgaacaacggcaataaaatcccggcgattgccatcatcggcactggtacaaagtggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacggcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 190 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYGKSEAQIILRWVTKRGVLPVTTSSKPQRISDAQNLFSFDLTAEEVDKITELGLEHEPLRLYWNKLYGKYNYAAQKV

SEQ ID NO: 191 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccatccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 192 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSHPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 193 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccaaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattatatggcaaatataactctgccgcccagaaagtgtaatga

SEQ ID NO: 194 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTKKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNSAAQKV

SEQ ID NO: 195 - DNA, 942 bp, Artificial Sequence
  Synthetic Construct
atgtcttttcaccaacagtttttcacgctgaacaacggcaataaaatcccggcgattgccatcatcggcactggtacagcctggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 196 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 197 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttggcattgaagaaaatgggtacagattatgttgatttatatctgattcattccccgtttgtttcgaaggaagtgaatggcctaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 198 - protein, 312 aa, Artificial Sequence; identical to SEQ ID NO: 186
  Synthetic Construct

SEQ ID NO: 199 - DNA, 942 bp, Artificial Sequence
  Synthetic Construct
atgtcttttcaccaacagtttttcacgctgaacaacggcaataaaatcccggcgattgccatcatcggcactggtacaaagtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 200 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 201 - DNA, 942 bp, Artificial Sequence
  Synthetic Construct
atgtcttttcaccaacagtttttcacgctgaacaacggcaataaaatcccggcgattgccattatcggcactggtacaaagtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacggcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 202 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYGKSEAQIILRWVTKRGVLPVTTSSKPQRISDAQNLFSFDLTAEEVDKITELGLEHEPLRLYWNKLYGKYNYAAQKV

SEQ ID NO: 203 - DNA, 942 bp, Artificial Sequence
  Synthetic Construct
atgtcttttcaccaacagtttttcacgctgaacaacggcaataaaatcccggcgactgccattatcggcactggtacaaagtggtataaaagtgaagaaactgacgcgaccttctccaatagtctggttgaacaaatcgtgtacgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacggcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 204 - protein, 312 aa, Artificial Sequence
  Synthetic Construct
MSFHQQFFTLNNGNKIPATAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYGKSEAQIILRWVTKRGVLPVTTSSKPQRISDAQNLFSFDLTAEEVDKITELGLEHEPLRLYWNKLYGKYNYAAQKV

SEQ ID NO: 205 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggaggtttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 206 - protein, 312 aa, Artificial Sequence
  Synthetic Construct
MSFHQQFFTLNNGNKIPAIAIIGTGTKWYKNEETDATFSNSLVEQIVYALKLPGIIHIDAAEVYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 207 - DNA, 942 bp, Artificial Sequence
  Synthetic Construct
atgtcttttcaccaacagtttttcacgctgaacaacggcaataaaatcccggcgattgccatcatcggcactggtacaaagtggtataaaagtgaagaaactgacgcgaccttctccaatagtctggttgaacaaatcgtgtatgcgttggaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcagatataactacgccgcccagaaagtgtaatga

SEQ ID NO: 208 - protein, 312 aa, Artificial Sequence
  Synthetic Construct
MSFHQQFFTLNNGNKIPAIAIIGTGTKWYKSEETDATFSNSLVEQIVYALELPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGRYNYAAQKV

SEQ ID NO: 209 - DNA, 942 bp, Artificial Sequence
  Synthetic Construct
atgtcttttcaccaacagtttttcacgctgaacaacggcaataaaatcccggcgattgccatcatcggcactggtacaaaatggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaataccgcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 210 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYRKSEAQIILRWVTKRGVLPVTTSSKPQRISDAQNLFSFDLTAEEVDKITELGLEHEPLRLYWNKLYGKYNYAAQKV

SEQ ID NO: 211 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccagacatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactctgccgcccaaaaagtgtaatga

SEQ ID NO: 212 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPDIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNSAAQKV

SEQ ID NO: 213 - DNA, 942 bp, Artificial Sequence
  Synthetic Construct
atgtcttttcaccaacagtttttcacgctgaacaacggcaataaaatcccggcgattgccatcatcggcactggtacagcctggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaataccgcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 214 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYRKSEAQIILRWVTKRGVLPVTTSSKPQRISDAQNLFSFDLTAEEVDKITELGLEHEPLRLYWNKLYGKYNYAAQKV

SEQ ID NO: 215 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccaaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagagaaccgcgcaggatgacagccaaccattctttgagtacgtcaaagaattgagcgaaaaatacggcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 216 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTKKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKRTAQDDSQPFFEYVKELSEKYGKSEAQIILRWVTKRGVLPVTTSSKPQRISDAQNLFSFDLTAEEVDKITELGLEHEPLRLYWNKLYGKYNYAAQKV

SEQ ID NO: 217 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatactctccgctgggcccgctgcggaagaaaaccgcgcaggatgacagccaaccattttttgagtacgtcaaagaattgagcgaaaaatacggcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 218 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYGKSEAQIILRWVTKRGVLPVTTSSKPQRISDAQNLFSFDLTAEEVDKITELGLEHEPLRLYWNKLYGKYNYAAQKV

SEQ ID NO: 219 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattgtccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 220 - protein, 312 aa, Artificial Sequence
  Synthetic Construct
MSFHQQFFTLNNGNKIPAIAIIGTGTKWYKNEETDATFSNSLVEQIVYALKLPGIVHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 221 - DNA, 942 bp, Artificial Sequence
  Synthetic Construct
atgtcttttcaccaacagtttttcacactgaacaacggcaataaaatcccggcgattgccatcatcggcactggtacaaaatggtataaaagtgaagaaactgacgcgaccttctccaatagtctggttgaacaaatcgtgtatgcgttgaaactgccggggattatccacatcgacgccgcggaggtttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 222 - protein, 312 aa, Artificial Sequence
  Synthetic Construct
MSFHQQFFTLNNGNKIPAIAIIGTGTKWYKSEETDATFSNSLVEQIVYALKLPGIIHIDAAEVYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 223 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaagcctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattctttgagtacgtcaaagaattgagcgaaaaatacaacaaatccgaggcccagatcatcctgcgctgggtcactagacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatacaactacgccgcccagaaagtgtaatga

SEQ ID NO: 224 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTRRGVLPVTTSSKPQRISDAQNLFSFDLTAEEVDKITELGLEHEPLRLYWNKLYGKYNYAAQKV

SEQ ID NO: 225 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagggaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 226 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEGNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 227 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggcgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 228 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 229 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccatacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagcggggtctggaacatgaaccgctgcgcctgtactggaataagttgtatggcaaatataactacgccgcccagaaagtgtaatga

SEQ ID NO: 230 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNHTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITERGLEHEPLRLYWNKLYGKYNYAAQKV

SEQ ID NO: 231 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaaccactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacggtatcctggtggaagcatattctccgctgggcccgctgcggaagaaaaccgcgcaggatgacagccaaccattttttgagtacgtcaaagaattgagcgaaaaatacggcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 232 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKPLSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHGILVEAYSPLGPLRKKTAQDDSQPFFEYVKELSEKYGKSEAQIILRWVTKRGVLPVTTSSKPQRISDAQNLFSFDLTAEEVDKITELGLEHEPLRLYWNKLYGKYNYAAQKV

SEQ ID NO: 233 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataaccacgccgcccagaaagtgtaatga

SEQ ID NO: 234 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNHAAQKV

SEQ ID NO: 235 - DNA, 942 bp, Artificial Sequence
  Synthetic Construct
atgtcttttcaccaacagtttttcacgctgaacaacggcaataaaatcccggcgattgccatcatcggcactggtacaaaatggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtttggaacatgaaccgctgcgcctgtactggaataaattgtatggcaaatataactacgccgcccagaaagtgtaatga

SEQ ID NO: 236 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 237 - DNA, 942 bp, Artificial Sequence
  Synthetic Construct
atgtcttttcaccaacagtttttcacgctgaacaacggcaataaaatcccggcgattgccatcatcggcactggtacaaagtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttctccgtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 238 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFSVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 239 - DNA, 942 bp, Artificial Sequence
  Synthetic Construct
atgtcttttcaccaacagtttttcacgctgaacaacggcaataaaatcccggcgattgccatcatcggcactggtacaaagtggtataaaagtgaagaaactgacgcgaccttctccaatagtctggttgaacaaatcgtgtatgcgttgaagctgccggggattatccacatcgacgccgcggagatttatcgcacctacccggaagtgggcaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaaccggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggagcatgaaccgctgcgcctgtactggaataaattgtatggcaaatataactctgccgcccagaaagtgtaatga

SEQ ID NO: 240 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKTGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNSAAQKV

SEQ ID NO: 241 - DNA, 942 bp, Artificial Sequence
  Synthetic Construct
atgtcttttcaccaacagtttttcacgctgaacaacggcaataaaatcccggcgattgccatcatcggcactggtacaaaatggtataaaaatgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacggattatgttgatttatatctgattcattccccgtttgtttcgaaggaagtgaatggcttaagcttagaagaggcttggaaagatatggagcagttatacaaaagtggtaaagctaaaaacatcggggtttccaatttctccgtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgcccagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 242 - protein, 312 aa, Artificial Sequence
  Synthetic Construct
MSFHQQFFTLNNGNKIPAIAIIGTGTKWYKNEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFSVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 243 - DNA, 942 bp, Artificial Sequence
  Synthetic Construct
atgtcttttcaccaacagtttttcacgctgaacaacggcaataaaatcccggcgattgccatcatcggcactggtacaaagtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccaaaaagcctcgtaacgcgatttttctgacggataaatattctccgcagattaaaatgagtgactcccctgcggacggtctggatttagcattgaagaaaatgggtacagattatgttgatttatatctgttacattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccactgcggaagaaaaccgcgcaggatgacagccaaccattttttgagtacgtcaaagaattgagcgaaaaatacggcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactctgccgcccagaaagtgtaatga

SEQ ID NO: 244 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTKKPRNAIFLTDKYSPQIKMSDSPADGLDLALKKMGTDYVDLYLLHSPFVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYGKSEAQIILRWVTKRGVLPVTTSSKPQRISDAQNLFSFDLTAEEVDKITELGLEHEPLRLYWNKLYGKYNSAAQKV

SEQ ID NO: 245 - DNA, 942 bp, Artificial Sequence
  Synthetic Construct
atgtcttttcaccaacagtttttcacgctgaacaacggcaataaaatcccggcgattgccatcatcggcactggtacaaagtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgttacgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 246 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVTKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 247 - DNA, 942 bp, Artificial Sequence
  Synthetic Construct
atgtcttttcaccaacagtttttcacgctgaacaacggcaataaaatcccggcgattgccatcatcggcactggtacagcctggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttctccgtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 248 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFSVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 249 - DNA, 942 bp, Artificial Sequence
  Synthetic Construct
atgtcttttcaccaacagtttttcacgctgaacaacggcaataaaatcccggcgattgccatcatcggcactggtacaaagtggtataaaagtgaagaaactgacgcgaccttctccaatagtctggttgaacaaatcgtgtacgcgttgaagctgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaaccggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 250 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKTGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 251 - DNA, 942 bp, Artificial Sequence
  Synthetic Construct
atgtcttttcaccaacagtttttcacgctgaacaacggcaataaaatcccggcgattgccatcatcggcactggtacaaagtggtataaaagtgaagaaactgacgcgaccttctccaatagtctggttgaacaaatcgtgtatgcgttgaaactgccggggattatccacatcgacgccgcggagatttatcgcacctacccggaagtgggcaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacggcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtataatga

SEQ ID NO: 252 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYGKSEAQIILRWVTKRGVLPVTTSSKPQRISDAQNLFSFDLTAEEVDKITELGLEHEPLRLYWNKLYGKYNYAAQKV

SEQ ID NO: 253 - DNA, 942 bp, Artificial Sequence
  Synthetic Construct
atgtcttttcaccaacagtttttcacgctgaacaacggcaataaaatcccggcgattgccatcatcggcactggtacaaagtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatatagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttctccgtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 254 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDIALKKMGTDYVDLYLIHSPFVSKEVNGLSLEEAWKDMEQLYKSGKAKNIGVSNFSVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 255 - DNA, 942 bp, Artificial Sequence
  Synthetic Construct
atgtcttttcaccaacagtttttcacgctgaacaacggcaataaaatcccggcgattgccatcatcggcactggtacagcctggtataaaagtgaagaaactgacgcgaccttctccaatagtctggttgaacaaatcgtgtacgcgttgaagctgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaagtggtaaagctaaaaacatcggggtttccaatttctccgtggaagacctgcaacgtatcctgaaagtcgctgaagttaaacctcaggtcaaccagattgagttctctccgttcctgcaaaaccaaacaccaggcatttataaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 256 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKSGKAKNIGVSNFSVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 257 - DNA, 942 bp, Artificial Sequence
  Synthetic Construct
atgtcttttcaccaacagtttttcacgctgaacaacggcaataaaatcccggcgattgccatcatcggcactggtacaaagtggtataaaagtgaagaaactgacgcgaccttctccaatagtctggttgaacaaatcgtgtacgcgttgaagctgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgtttgtttcgaaggaagtgaatggcttaagcttagaagaggcttggaaagatatggagcagttatacaaaaccggtaaagctaaaaacatcggggtttccaatttctccgtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaacaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 258 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPFVSKEVNGLSLEEAWKDMEQLYKTGKAKNIGVSNFSVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 259 - DNA, 942 bp, Artificial Sequence
  Synthetic Construct
atgtcttttcaccaacagtttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 260 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 261 - DNA, 942 bp, Artificial Sequence
  Synthetic Construct
atgtcttttcaccaacagtttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgcgtgtcgctgaagttaaacctcaggtcaaccagattgagttctctccgttcctgcaaaaccaaacaccaggcatttacaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 262 - protein, 312 aa, Artificial Sequence; identical to SEQ ID NO: 178
  Synthetic Construct

SEQ ID NO: 263 - DNA, 942 bp, Artificial Sequence
  Synthetic Construct
atgtcttttcaccaacagtttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttacaaattctgtcaggagcacgatatcctggtggaagcatattctccgctgggcccgctgcggaagaaaaccgcgcaggatgacagccaaccattttttgagtacgtcaaagaattgagcgaaaaataccgcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 264 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPLVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYRKSEAQIILRWVTKRGVLPVTTSSKPQRISDAQNLFSFDLTAEEVDKITELGLEHEPLRLYWNKLYGKYNYAAQKV

SEQ ID NO: 265 - DNA, 942 bp, Artificial Sequence
  Synthetic Construct
atgtcttttcaccaacagtttttcacgctgaacaacggcaataaaatcccggcgattgccatcatcggcactggtacaaaatggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggatgaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 266 - protein, 312 aa, Artificial Sequence
  Synthetic Construct
MSFHQQFFTLNNGNKIPAIAIIGTGTKWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRMKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 267 - DNA, 942 bp, Artificial Sequence
  Synthetic Construct
atgtcttttcaccaacagtttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgttcgtttcgaaggaagtgaatggcttaagcttagaagaggcttggaaagatatggagcagttatacaaaaccggtaaagctaaaaacatcggggtttccaatttcacagtggaagacctgcaacgtatcctgcgtgtcgctgaagttaaacctcaggtcaaccagattgagttctctccgttcctgcaaaaccaaacaccaggcatttacaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 268 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKTGKAKNIGVSNFTVEDLQRILRVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 269 - DNA, 942 bp, Artificial Sequence
  Synthetic Construct
atgtcttttcaccaacagtttttcacgctgaacaacggcaataaaatcccggcgattgccaccatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttacaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 270 - protein, 312 aa, Artificial Sequence
  Synthetic Construct
MSFHQQFFTLNNGNKIPAIATIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 271 - DNA, 942 bp, Artificial Sequence
  Synthetic Construct
atgtcttttcaccaacagtttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaataccgcaaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 272 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYRKSEAQIILRWVTKRGVLPVTTSSKPQRISDAQNLFSFDLTAEEVDKITELGLEHEPLRLYWNKLYGKYNYAAQKV

SEQ ID NO: 273 - DNA, 942 bp, Artificial Sequence
  Synthetic Construct
atgtcttttcaccaacagtttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgttacattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttacaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 274 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLLHSPLVSKEVNGLSLEEAWKDMEQLYKSGKAKNIGVSNFTVEDLQRILKVAEVKPQVNQIEFSPFLQNQTPGIYKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 275 - DNA, 942 bp, Artificial Sequence
  Synthetic Construct
atgtcttttcaccaacagtttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 276 - protein, 312 aa, Artificial Sequence
  Synthetic Construct
MSFHQQFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 277 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 278 - protein, 312 aa, Artificial Sequence
  Synthetic Construct
MSFHQQFFTLNNGNKIPAIAIIGTGTAWYKPEETDATFSNSLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 279 - DNA, 942 bp, Artificial Sequence
  Synthetic Construct
atgtcttttcaccaacagtttttcacgctgaacaacggcaataaaatcccggcggtcgccatcatcggcactggtacagcgtggtataaaagtgaagaaactgacgcgaccttctccaatagtctggttgatcaaatcgtgtatgcgttgaaactgccggggatcatccacatcgacgccgcggagatttatcgcacctacccggaagtgggtcgtgcactgtccctgaccgaaaagcctcgtaacgcgatttttctgacggataaatattctccgcagattaaaatgagtgactcccctgcggacggtctggaattagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgctcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccaggtgatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaccatgaaccgctgcgcctgtactggaataaattgtatggcaaatataactacgccgcccagaaagtgtaatga

SEQ ID NO: 280 - protein, 312 aa, Artificial Sequence
  Synthetic Construct
MSFHQQFFTLNNGNKIPAVAIIGTGTAWYKSEETDATFSNSLVDQIVYALKLPGIIHIDAAEIYRTYPEVGRALSLTEKPRNAIFLTDKYSPQIKMSDSPADGLELALKKMGTDYVDLYLIHSPLVSKEVNGLSLEEAWKDMEQLYKSGKAKNIGVSNFTVEDLQRILKVAEVKPQVNQIEFSPLLQNQTPGICKFCQEHDILVEAYSPLGPLRKKTAQDDSQPFFEYVKELSEKYNKSEAQVILRWVTKRGVLPVTTSSKPQRISDAQNLFSFDLTAEEVDKITELGLDHEPLRLYWNKLYGKYNYAAQKV

SEQ ID NO: 281 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaataccctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcagcaacacgacatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacatcttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 282 - protein, 312 aa, Artificial Sequence
  Synthetic Construct
MSFHQEFFTLNNGNKIPAIAIIGTGTAWYKSEETDATFSNTLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQQHDILVEAYSPLGPLRKKTAQDDSQPFFEYVKELSEKYNKSEAQIILRWVTKRGVLPVTTSSKPQRISDAQNIFSFDLTAEEVDKITELGLEHEPLRLYWNKLYGKYNYAAQKV

SEQ ID NO: 283 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaataccctggttgaacaattagtgtatgcgttgaaactgccgggggttatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcagcaacacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 284 - protein, 312 aa, Artificial Sequence
  Synthetic Construct
MSFHQEFFTLNNGNKIPAIAIIGTGTAWYKSEETDATFSNTLVEQLVYALKLPGVIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQQHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 285 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaataccctggttgaacaattagtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgctgcattccccgttagtttcgaaggaagtgaatggcttaagcttagaagaggcttggaaagatatggaggagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcagcaacacgatatcctggtggaagcatattctccgctgggcccgctgcggaagaaaaccgcgcaggatgacagccaaccattttttgagtacgtcaaagaattgagcgaaaaatacaataaaaccgaggcccagatcatcctgcgctgggtcactaaacgcggtgtgctgccagttaccacctcttcaaagcctcagcgcattagcgatgctcagaacatcttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 286 - protein, 312 aa, Artificial Sequence
  Synthetic Construct
MSFHQEFFTLNNGNKIPAIAIIGTGTAWYKSEETDATFSNTLVEQLVYALKLPGIIHIDAAEIYRTYPEVGKALSLTEKPRNAIFLTDKYSPQIKMSDSPADGLDLALKKMGTDYVDLYLLHSPLVSKEVNGLSLEEAWKDMEELYKSGKAKNIGVSNFTVEDLQRILKVAEVKPQVNQIEFSPFLQNQTPGICKFCQQHDILVEAYSPLGPLRKKTAQDDSQPFFEYVKELSEKYNKTEAQIILRWVTKRGVLPVTTSSKPQRISDAQNIFSFDLTAEEVDKITELGLEHEPLRLYWNKLYGKYNYAAQKV

SEQ ID NO: 287 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaatagtctggttgaacaattagtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaaaccgaggcccagatcttactgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 288 - protein, 312 aa, Artificial Sequence
  Synthetic Construct
MSFHQEFFTLNNGNKIPAIAIIGTGTAWYKSEETDATFSNSLVEQLVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKTEAQILLRWVTKRGVLPVTTSSKPQRISDAQNLFSFDLTAEEVDKITELGLEHEPLRLYWNKLYGKYNYAAQKV

SEQ ID NO: 289 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaaaccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctacgcctgtactggaataaattgtatggcaaatataactacgccgcccagaaagtgtaatga

SEQ ID NO: 290 - protein, 312 aa, Artificial Sequence
  Synthetic Construct
MSFHQEFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKTEAQIILRWVTKRGVLPVTTSSKPQRISDAQNLFSFDLTAEEVDKITELGLEHEPLRLYWNKLYGKYNYAAQKV

SEQ ID NO: 291 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaataccctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacatcttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 292 - protein, 312 aa, Artificial Sequence
  Synthetic Construct
MSFHQEFFTLNNGNKIPAIAIIGTGTAWYKSEETDATFSNTLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNIFSFDLTAEEVDKITELGLEHEPLRLYWNKLYGKYNYAAQKV

SEQ ID NO: 293 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagccagaaatacaataaaaccgaggcccagatcatcctgcgctgggtcactaaacgcggtgtgctgccagttaccacctcttcaaaacctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 294 - protein, 312 aa, Artificial Sequence
  Synthetic Construct
MSFHQEFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSQKYNKTEAQIILRWVTKRGVLPVTTSSKPQRISDAQNLFSFDLTAEEVDKITELGLEHEPLRLYWNKLYGKYNYAAQKV

SEQ ID NO: 295 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacctggacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgctgcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcagcaacacgatatcctggtggaagcatattctccgctgggcccgctgcggaagaaaaccgcgcaggatgacagccaaccattttttgagtacgtcaaagaattgagcgaaaaatacaataaatccgaggcccagatcttactgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 296 - protein, 312 aa, Artificial Sequence
  Synthetic Construct
MSFHQEFFTLNNGNKIPAIAIIGTGTAWYKSEETDATFSNSLVEQIVYALKLPGIIHLDAAEIYRTYPEVGKALSLTEKPRNAIFLTDKYSPQIKMSDSPADGLDLALKKMGTDYVDLYLLHSPLVSKEVNGLSLEEAWKDMEQLYKSGKAKNIGVSNFTVEDLQRILKVAEVKPQVNQIEFSPFLQNQTPGICKFCQQHDILVEAYSPLGPLRKKTAQDDSQPFFEYVKELSEKYNKSEAQILLRWVTKRGVLPVTTSSKPQRISDAQNLFSFDLTAEEVDKITELGLEHEPLRLYWNKLYGKYNYAAQKV

SEQ ID NO: 297 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaatagtctggttgaacaattagtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcagcaacacgatatcctggtggaagcatattctccgctgggcccgctgcggaagaaaaccgcgcaggatgacagccaaccattttttgagtacgtcaaagaattgagcgaaaaatacaataaaaccgaggcccagatcttactgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 298 - protein, 312 aa, Artificial Sequence
  Synthetic Construct
MSFHQEFFTLNNGNKIPAIAIIGTGTAWYKSEETDATFSNSLVEQLVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQQHDILVEAYSPLGPLRKKTAQDDSQPFFEYVKELSEKYNKTEAQILLRWVTKRGVLPVTTSSKPQRISDAQNLFSFDLTAEEVDKITELGLEHEPLRLYWNKLYGKYNYAAQKV

SEQ ID NO: 299 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacctggacgccgcggagatttatcgcacctacccggaagtgggtaaagcactgtccctgaccgaaaagcctcgtaacgcgatttttatcacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaaaccgaggcccagatcttactgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 300 - protein, 312 aa, Artificial Sequence
  Synthetic Construct
MSFHQEFFTLNNGNKIPAIAIIGTGTAWYKSEETDATFSNSLVEQIVYALKLPGIIHLDAAEIYRTYPEVGKALSLTEKPRNAIFITDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKTEAQILLRWVTKRGVLPVTTSSKPQRISDAQNLFSFDLTAEEVDKITELGLEHEPLRLYWNKLYGKYNYAAQKV

SEQ ID NO: 301 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaatagtctggttgaacaattagtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaaaccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 302 - protein, 312 aa, Artificial Sequence
  Synthetic Construct
MSFHQEFFTLNNGNKIPAIAIIGTGTAWYKSEETDATFSNSLVEQLVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKTEAQIILRWVTKRGVLPVTTSSKPQRISDAQNLFSFDLTAEEVDKITELGLEHEPLRLYWNKLYGKYNYAAQKV

SEQ ID NO: 303 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagcgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacatcttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 304 - protein, 312 aa, Artificial Sequence
  Synthetic Construct
MSFHQEFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNIFSFDLTAEEVDKITELGLEHEPLRLYWNKLYGKYNYAAQKV

SEQ ID NO: 305 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaatagtctggttgaacaattagtgtatgcgttgaaactgccggggattatccacctggacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggaggagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccacccagaaagtgtaatga

SEQ ID NO: 306 - protein, 312 aa, Artificial Sequence
  Synthetic Construct
MSFHQEFFTLNNGNKIPAIAIIGTGTAWYKSEETDATFSNSLVEQLVYALKLPGIIHLDAAEIYRTYPEVGKALSLTEKPRNAIFLTDKYSPQIKMSDSPADGLDLALKKMGTDYVDLYLIHSPLVSKEVNGLSLEEAWKDMEELYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYATQKV

SEQ ID NO: 307 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggaggagttatacaaaagtggtaaagctaaaaacatcggggtttccaatttcacagtggaagacctggaacgtatcctgaaagtcgctgaagttaaacctcaggtcaaccagattgagttctctccgttcctgcaaaaccaaacaccaggcatttgcaaattctgtcagcaacacgatatcctggtggaagcatattctccgctgggcccgctgcggaagaaaaccgcgcaggatgacagccaaccattttttgagtacgtcaaagaattgagcgaaaaatacaataaaaccgaggcccagatcttactgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaacataactacgccgcccagaaagtgtaatga

SEQ ID NO: 308 - protein, 312 aa, Artificial Sequence
  Synthetic Construct
MSFHQEFFTLNNGNKIPAIAIIGTGTAWYKSEETDATFSNSLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEELYKSGKAKNIGVSNFTVEDLERILKVAEVKPQVNQIEFSPFLQNQTPGICKFCQQHDILVEAYSPLGPLRKKTAQDDSQPFFEYVKELSEKYNKTEAQILLRWVTKRGVLPVTTSSKPQRISDAQNLFSFDLTAEEVDKITELGLEHEPLRLYWNKLYGKHNYAAQKV

SEQ ID NO: 309 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaataccctggttgaacaattagtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtataatga

SEQ ID NO: 310 - protein, 312 aa, Artificial Sequence
  Synthetic Construct
MSFHQEFFTLNNGNKIPAIAIIGTGTAWYKSEETDATFSNTLVEQLVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 311 - DNA, 942 bp, Artificial Sequence
  Synthetic Construct
atgtcttttcaccaagaatttttcacgctgaacaacggcaataaaatcccggcgattgccatcatcggcactggtacagcgtggtataaaagtgaagaaactgacgcgaccttctccaataccctggttgaacaattagtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctaggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 312 - protein, 312 aa, Artificial Sequence; identical to SEQ ID NO: 310
  Synthetic Construct

SEQ ID NO: 313 - DNA, 942 bp, Artificial Sequence
  Synthetic Construct
atgtcttttcaccaagaatttttcacgctgaacaacggcaataaaatcccggcgattgccatcatcggcactggtacagcgtggtataaacccgaagaaactgacgcgaccttctccaatagtctggttgaacaattagtgtatgcgttgaaactgccggggattatccacatcgacgccgcggagatttatcgcacctacccggaagtgggtaaagcactgtccctgaccgaaaagcctcgtaacgcgatttttatcacggataaatattctccgcagattaaaatgagcgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctaggcccgctgcggaagaaaaccgcgcaggatgacagccaaccattttttgagtacgtcaaagaattgagcgaaaaatacaataaaaccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtataatga

SEQ ID NO: 314 - protein, 312 aa, Artificial Sequence
  Synthetic Construct
MSFHQEFFTLNNGNKIPAIAIIGTGTAWYKPEETDATFSNSLVEQLVYALKLPGIIHIDAAEIYRTYPEVGKALSLTEKPRNAIFITDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKTEAQIILRWVTKRGVLPVTTSSKPQRISDAQNLFSFDLTAEEVDKITELGLEHEPLRLYWNKLYGKYNYAAQKV

SEQ ID NO: 315 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtgtaatga

SEQ ID NO: 316 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKLYGKYNYAAQKV

SEQ ID NO: 317 - DNA, 942 bp, Artificial Sequence; identical to SEQ ID NO: 315
  Synthetic Construct

SEQ ID NO: 318 - protein, 312 aa, Artificial Sequence; identical to SEQ ID NO: 316
  Synthetic Construct

SEQ ID NO: 319 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtggtggaataaattgtatggcaaatataactacgccgcccagaaagtgtaatga

SEQ ID NO: 320 - protein, 312 aa, Artificial Sequence
  Synthetic Construct
MSFHQQFFTLNNGNKIPAIAIIGTGTAWYKPEETDATFSNSLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKLYGKYNYAAQKV

SEQ ID NO: 321 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaaaggtatggcaaatataactacgccgcccagaaagtgtaatga

SEQ ID NO: 322 - protein, 312 aa, Artificial Sequence
  Synthetic Construct
MSFHQQFFTLNNGNKIPAIAIIGTGTAWYKPEETDATFSNSLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKRYGKYNYAAQKV

SEQ ID NO: 323 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagatttatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaaaagtatggcaaatataactacgccgcccagaaagtgtaatga

SEQ ID NO: 324 - protein, 312 aa, Artificial Sequence
  Synthetic Construct
MSFHQQFFTLNNGNKIPAIAIIGTGTAWYKPEETDATFSNSLVEQIVYALKLPGIIHIDAAEIYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKKYGKYNYAAQKV

SEQ ID NO: 325 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtggtggaataaattgtatggcaaatataactacgccgcccagaaagtgtaatga

SEQ ID NO: 326 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKLYGKYNYAAQKV

SEQ ID NO: 327 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtggtggaataaaaagtatggcaaatataactacgccgcccagaaagtgtaatga

SEQ ID NO: 328 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKKYGKYNYAAQKV

SEQ ID NO: 329 - DNA, 942 bp, Artificial Sequence
  Synthetic Construct
atgtcttttcaccaagaatttttcacgctgaacaacggcaataaaatcccggcgattgccatcatcggcactggtacagcgtggtataaacccgaagaaactgacgcgaccttctccaatagtctggttgaacaattagtgtatgcgttgaaactgccggggattatccacatcgacgccgcggagtggtatcgcacctacccggaagtgggtaaagcactgtccctgaccgaaaagcctcgtaacgcgatttttatcacggataaatattctccgcagattaaaatgagcgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctaggcccgctgcggaagaaaaccgcgcaggatgacagccaaccattttttgagtacgtcaaagaattgagcgaaaaatacaataaaaccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaattgtatggcaaatataactacgccgcccagaaagtataatga

SEQ ID NO: 330 - protein, 312 aa, Artificial Sequence
  Synthetic Construct
MSFHQEFFTLNNGNKIPAIAIIGTGTAWYKPEETDATFSNSLVEQLVYALKLPGIIHIDAAEWYRTYPEVGKALSLTEKPRNAIFITDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKTEAQIILRWVTKRGVLPVTTSSKPQRISDAQNLFSFDLTAEEVDKITELGLEHEPLRLYWNKLYGKYNYAAQKV

SEQ ID NO: 331 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtggtggaataaagcgtatggcaaatataactacgccgcccagaaagtgtaatga

SEQ ID NO: 332 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKAYGKYNYAAQKV

SEQ ID NO: 333 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtggtggaataaatcgtatggcaaatataactacgccgcccagaaagtgtaatga

SEQ ID NO: 334 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKSYGKYNYAAQKV

SEQ ID NO: 335 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtggtggaataaagagtatggcaaatataactacgccgcccagaaagtgtaatga

SEQ ID NO: 336 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKEYGKYNYAAQKV

SEQ ID NO: 337 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtggtggaataaaccttatggcaaatataactacgccgcccagaaagtgtaatga

SEQ ID NO: 338 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKPYGKYNYAAQKV

SEQ ID NO: 339 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggcctggaacatgaaccgctgcgcctgtggtggaataaacagtatggcaaatataactacgccgcccagaaagtgtaatga

SEQ ID NO: 340 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKQYGKYNYAAQKV

SEQ ID NO: 341 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtattggaataaagagtatggcaaatataactacgccgcccagaaagtgtaatga

SEQ ID NO: 342 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKEYGKYNYAAQKV

SEQ ID NO: 343 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatggtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaagcgtatggcaaatataactacgccgcccagaaagtgtaatga

SEQ ID NO: 344 - protein, 312 aa, Artificial Sequence
  Synthetic Construct
MSFHQQFFTLNNGNKIPAIAIIGTGTAWYKPEETDATFSNGLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLYWNKAYGKYNYAAQKV

SEQ ID NO: 345 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgttttggaataaagagtatggcaaatataactacgccgcccagaaagtgtaatga

SEQ ID NO: 346 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLFWNKEYGKYNYAAQKV

SEQ ID NO: 347 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatggaacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggcctggaacatgaaccgctgcgcctgtggtggaataaacagtatggcaaatataactacgccgcccagaaagtgtaatga

SEQ ID NO: 348 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYGTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKQYGKYNYAAQKV

SEQ ID NO: 349 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtattcgacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggcctggaacatgaaccgctgcgcctgtggtggaataaacagtatggcaaatataactacgccgcccagaaagtgtaatga

SEQ ID NO: 350 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYSTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKQYGKYNYAAQKV

SEQ ID NO: 351 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgtgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggcctggaacatgaaccgctgcgcctgtggtggaataaacagtatggcaaatataactacgccgcccagaaagtgtaatga

SEQ ID NO: 352 - protein, 312 aa, Artificial Sequence
  Synthetic Construct
MSFHQQFFTLNNGNKIPAIAIIGTGTAWYKPEETDVTFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKQYGKYNYAAQKV

SEQ ID NO: 353 - DNA, 943 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggcctggaacatgaaccgctgcgcctgtggtggaataaacagtatggcaaatataactacgccgcccgagaaagtgtaatga

SEQ ID NO: 354 - protein, 314 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKQYGKYNYAARESVM

SEQ ID NO: 355 - DNA, 942 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccacgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggcctggaacatgaaccgctgcgcctgtggtggaataaacagtatggcaaatataactacgccgcccagaaagtgtaatga

SEQ ID NO: 356 - protein, 312 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTTQDDSQPFFEYVKELSEKYNKSEAQIILRWVTKRGVLPVTTSSKPQRISDAQNLFSFDLTAEEVDKITELGLEHEPLRLWWNKQYGKYNYAAQKV

SEQ ID NO: 357 - DNA, 943 bp, Artificial Sequence
  Synthetic Construct
atgtcttttcaccaacagtttttcacgctgaacaacggcaataaaatcccggcgattgccatcatcggcactggtacagcgtggtataaacccgaagaaactgacgcgaccttctccaatagtctggttgaacaaatcgtgtatgcgttgaaactgccggggattatccacatcgacgccgcggagtggtatcgcacctacccggaagtgggtaaagcactgtccctgaccgaaaagcctcgtaacgcgatttttctgacggataaatattctccgcagattaaaatgagtgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctgggcccgctgcggaagaaaaccgcgcaggatgacagccaaccattttttgagtacgtcaaagaattgagcgaaaaatacaataaatccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggcctggaacatgaaccgctgcgcctgtggtggaataaacagtatggcaaatataactacgccgccccagaaagtgtaatga

SEQ ID NO: 358 - protein, 314 aa, Artificial Sequence
  Synthetic Construct
MSFHQQFFTLNNGNKIPAIAIIGTGTAWYKPEETDATFSNSLVEQIVYALKLPGIIHIDAAEWYRTYPEVGKALSLTEKPRNAIFLTDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKSEAQIILRWVTKRGVLPVTTSSKPQRISDAQNLFSFDLTAEEVDKITELGLEHEPLRLWWNKQYGKYNYAAPESVM

SEQ ID NO: 359 - DNA, 942 bp, Artificial Sequence
  Synthetic Construct
atgtcttttcaccaagaatttttcacgctgaacaacggcaataaaatcccggcgattgccatcatcggcactggtacagcgtggtataaacccgaagaaactgacgcgaccttctccaatagtctggttgaacaattagtgtatgcgttgaaactgccggggattatccacatcgacgccgcggagtggtatcgcacctacccggaagtgggtaaagcactgtccctgaccgaaaagcctcgtaacgcgatttttatcacggataaatattctccgcagattaaaatgagcgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctaggcccgctgcggaagaaaaccgcgcaggatgacagccaaccattttttgagtacgtcaaagaattgagcgaaaaatacaataaaaccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtactggaataaagagtatggcaaatataactacgccgcccagaaagtataatga

SEQ ID NO: 360 - protein, 312 aa, Artificial Sequence
  Synthetic Construct
MSFHQEFFTLNNGNKIPAIAIIGTGTAWYKPEETDATFSNSLVEQLVYALKLPGIIHIDAAEWYRTYPEVGKALSLTEKPRNAIFITDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKTEAQIILRWVTKRGVLPVTTSSKPQRISDAQNLFSFDLTAEEVDKITELGLEHEPLRLYWNKEYGKYNYAAQKV

SEQ ID NO: 361 - DNA, 942 bp, Artificial Sequence
  Synthetic Construct
atgtcttttcaccaagaatttttcacgctgaacaacggcaataaaatcccggcgattgccatcatcggcactggtacagcgtggtataaacccgaagaaactgacgcgaccttctccaatagtctggttgaacaattagtgtatgcgttgaaactgccggggattatccacatcgacgccgcggagatttatcgcacctacccggaagtgggtaaagcactgtccctgaccgaaaagcctcgtaacgcgatttttatcacggataaatattctccgcagattaaaatgagcgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctaggcccgctgcggaagaaaaccgcgcaggatgacagccaaccattttttgagtacgtcaaagaattgagcgaaaaatacaataaaaccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtggtggaataaattgtatggcaaatataactacgccgcccagaaagtataatga

SEQ ID NO: 362 - protein, 312 aa, Artificial Sequence
  Synthetic Construct
MSFHQEFFTLNNGNKIPAIAIIGTGTAWYKPEETDATFSNSLVEQLVYALKLPGIIHIDAAEIYRTYPEVGKALSLTEKPRNAIFITDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKTEAQIILRWVTKRGVLPVTTSSKPQRISDAQNLFSFDLTAEEVDKITELGLEHEPLRLWWNKLYGKYNYAAQKV

SEQ ID NO: 363 - DNA, 942 bp, Artificial Sequence
  Synthetic Construct
atgtcttttcaccaagaatttttcacgctgaacaacggcaataaaatcccggcgattgccatcatcggcactggtacagcgtggtataaacccgaagaaactgacgcgaccttctccaatagtctggttgaacaattagtgtatgcgttgaaactgccggggattatccacatcgacgccgcggagtggtatcgcacctacccggaagtgggtaaagcactgtccctgaccgaaaagcctcgtaacgcgatttttatcacggataaatattctccgcagattaaaatgagcgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctaggcccgctgcggaagaaaaccgcgcaggatgacagccaaccattttttgagtacgtcaaagaattgagcgaaaaatacaataaaaccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtggtggaataaattgtatggcaaatataactacgccgcccagaaagtataatga

SEQ ID NO: 364 - protein, 312 aa, Artificial Sequence
  Synthetic Construct
MSFHQEFFTLNNGNKIPAIAIIGTGTAWYKPEETDATFSNSLVEQLVYALKLPGIIHIDAAEWYRTYPEVGKALSLTEKPRNAIFITDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKTEAQIILRWVTKRGVLPVTTSSKPQRISDAQNLFSFDLTAEEVDKITELGLEHEPLRLWWNKLYGKYNYAAQKV

SEQ ID NO: 365 - DNA, 942 bp, Artificial Sequence
  Synthetic Construct
atgtcttttcaccaagaatttttcacgctgaacaacggcaataaaatcccggcgattgccatcatcggcactggtacagcgtggtataaacccgaagaaactgacgcgaccttctccaatagtctggttgaacaattagtgtatgcgttgaaactgccggggattatccacatcgacgccgcggagtggtatcgcacctacccggaagtgggtaaagcactgtccctgaccgaaaagcctcgtaacgcgatttttatcacggataaatattctccgcagattaaaatgagcgactcccctgcggacggtctggatttagcattgaagaaaatgggtacagattatgttgatttatatctgattcattccccgttagtttcgaaggaagtgaatggcttaagcttagaagaggcttggaaagatatggagcagttatacaaaagtggtaaagctaaaaacatcggggtttccaatttcacagtggaagacctgcaacgtatcctgaaagtcgctgaagttaaacctcaggtcaaccagattgagttctctccgttcctgcaaaaccaaacaccaggcatttgcaaattctgtcaggagcacgatatcctggtggaagcatattctccgctaggcccgctgcggaagaaaaccgcgcaggatgacagccaaccattttttgagtacgtcaaagaattgagcgaaaaatacaataaaaccgaggcccagatcatcctgcgctgggtcactaaacgcggtgtgctgccagttaccacctcttcaaagcctcagcgcattagcgatgctcagaacctgttttccttcgacctgacagcggaagaggttgataaaatcacggagctgggtctggaacatgaaccgctgcgcctgtggtggaataaacagtatggcaaatataactacgccgcccagaaagtataatga

SEQ ID NO: 366 - protein, 312 aa, Artificial Sequence
  Synthetic Construct
MSFHQEFFTLNNGNKIPAIAIIGTGTAWYKPEETDATFSNSLVEQLVYALKLPGIIHIDAAEWYRTYPEVGKALSLTEKPRNAIFITDKYSPQIKMSDSPADGLDLALKKMGTDYVDLYLIHSPLVSKEVNGLSLEEAWKDMEQLYKSGKAKNIGVSNFTVEDLQRILKVAEVKPQVNQIEFSPFLQNQTPGICKFCQEHDILVEAYSPLGPLRKKTAQDDSQPFFEYVKELSEKYNKTEAQIILRWVTKRGVLPVTTSSKPQRISDAQNLFSFDLTAEEVDKITELGLEHEPLRLWWNKQYGKYNYAAQKV

What is claimed is:

1. An engineered or isolated ketoreductase enzyme capable of stereoselectively reducing the 3-oxo group of a 5-hydroxy-3-oxohexanoate to yield the corresponding syn 3,5-dihydroxyhexanoate ester and having increased enzyme specific activity as compared to the wild-type enzyme of SEQ ID NO:2, wherein the ketoreductase enzyme comprises an amino acid sequence that is at least 90% identical to SEQ ID NO:2 and includes an aromatic amino acid at residue position 63 ($X^{63}$).

2. The ketoreductase enzyme of claim 1, wherein the specific activity of the ketoreductase is at least about 1.5 times or greater than the specific activity of the wild-type enzyme of SEQ ID NO:2.

3. The ketoreductase enzyme of claim 1, wherein the aromatic amino acid is tryptophan.

4. The ketoreductase enzyme of claim 1, which comprises an amino acid sequence that is at least about 95% identical to SEQ ID NO:2.

5. The ketoreductase enzyme of claim 1, which comprises an amino acid sequence that includes one or more of the following characteristics:
$X^6$ is a polar or acidic amino acid residue;
$X^{27}$ is an aliphatic or basic amino acid residue;
$X^{31}$ is a hydroxyl containing or aliphatic amino acid residue;
$X^{36}$ is a small amino acid residue;
$X^{48}$ is a basic amino acid residue;
$X^{65}$ is a hydroxyl containing or small amino acid residue;
$X^{86}$ is an aliphatic or hydrophobic amino acid residue;
$X^{125}$ is an aliphatic or aromatic amino acid residue;
$X^{152}$ is a basic amino acid residue;
$X^{160}$ is a hydroxyl containing or small amino acid residue;
$X^{165}$ is a polar or acidic amino acid residue;
$X^{194}$ is an aromatic amino acid or polar hydrophilic amino acid residue;
$X^{214}$ is a polar hydrophilic amino acid residue;
$X^{218}$ is a hydroxyl containing amino acid residue;
$X^{234}$ is a polar hydrophilic amino acid residue;
$X^{248}$ is an aliphatic amino acid residue;
$X^{250}$ is a basic amino acid residue;
$X^{263}$ is a acidic or polar amino acid residue;
$X^{290}$ is an acidic amino acid residue;
$X^{296}$ is an aliphatic amino acid residue;
$X^{297}$ is an aromatic amino acid residue;
$X^{301}$ is an aliphatic or hydroxyl containing or acidic or hydrophilic or basic amino acid residue; and
$X^{307}$ is an aromatic, a polar or a hydroxyl containing amino acid residue.

6. The ketoreductase enzyme of claim 5 which includes one or more substitutions as compared to SEQ ID NO:2 selected from:
$X^6$ is E;
$X^{27}$ is A or K;
$X^{31}$ is S or P;
$X^{36}$ is V;
$X^{48}$ is H;
$X^{65}$ is G or S;
$X^{86}$ is I;
$X^{125}$ is L;
$X^{152}$ is R;
$X^{160}$ is T or S;
$X^{165}$ is E;
$X^{194}$ is C;
$X^{214}$ is R or H;
$X^{218}$ is T;
$X^{234}$ is Q;
$X^{248}$ is I;
$X^{250}$ is R;
$X^{263}$ is E;
$X^{290}$ is V;
$X^{296}$ is I;
$X^{297}$ is F or W;
$X^{301}$ is R, K, A, V, S, T, Y, D, E, P, or Q; and
$X^{307}$ is H, N or S.

7. The ketoreductase enzyme of claim 1 which comprises an amino acid sequence selected from SEQ ID NOS: 316, 318, 326, 328, 330, 332, 334, 336, 338, 340, 342, 344, 346, 348, 350, 352, 354, 356, 358, 360, 364, and 366.

8. A process for preparing a syn 3,5-dihydroxyhexanoate compound according to formula (IIa):

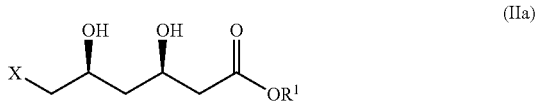

wherein X is selected from halo, cyano and —$OR^6$, where $R^6$ is hydrogen or a protecting group, and $R^1$ is selected from (C1-C12) alkyl, (C6-C10) aryl and (C7-C12) arylalkyl, comprising stereoselectively reducing an enantiomer of a 5-hydroxy-3-oxohexanoate compound according to structural formula (Ia):

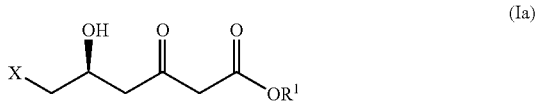

wherein X and $R^1$ are as defined for structural formula (IIa);

using a ketoreductase according to claim 1 under conditions suitable for reducing the 3-oxo group to a 3-hydroxy group.

9. The process of claim 8 which further comprises recovering the 3,5-dihydroxyhexanoate compound according to structural formula (IIa) from the reaction mixture.

10. The process of claim 8 in which the 5-hydroxy-3-oxohexanoate compound is substantially pure in the enantiomer of structural formula (Ia).

11. The process of claim 8 which is carried out with whole cells that express the ketoreductase enzyme, or an extract or lysate of such cells.

12. The process of claim 8 in which the ketoreductase is isolated and/or purified and the enantioselective reduction reaction is carried out in the presence of a cofactor for the ketoreductase and optionally a regeneration system for the cofactor.

13. The process of claim 8 which is carried out at a temperature in the range of about 15° C. to about 75° C.

14. The process of claim 8 which is carried out at a pH in the range of about pH 5 to pH 8.

15. The process of claim 8 in which the weight ratio of the 5-hydroxy-3-oxohexanoate compound of structural formula (Ia) to the ketoreductase enzyme is in the range of about 10:1 to 200:1.

16. The process of claim 8 in which X is selected from chloro, cyano and hydroxyl, and in which $R^1$ is a lower alkanyl or t-butyl.

17. The process of claim 8 which is carried out in the presence of a cofactor and optionally a cofactor regeneration system.

18. The process of claim 17 in which the cofactor is NADH and/or NADPH, and in which the weight ratio of the cofactor to the ketoreductase enzyme is in the range of about 10:1 to 100:1.

19. The process of claim 17 in which the cofactor regenerating system comprises glucose dehydrogenase and glucose; formate dehydrogenase and formate; or isopropanol and a secondary alcohol dehydrogenase.

20. The process of claim 19 wherein the secondary alcohol dehydrogenase is the ketoreductase.

21. The process of claim 8 in which the preparation of 3,5-dihydroxyhexanoate compound is a substantially pure in the syn diastereomer.

22. A reaction mixture comprising a ketoreductase enzyme according to claim 1, a cofactor for said ketoreductase enzyme and a substrate according to structural formula (Ia):

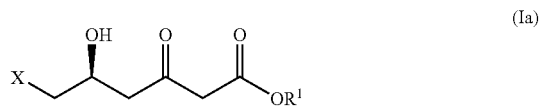

wherein X is selected from halo, cyano and —$OR^6$, where $R^6$ is hydrogen or a protecting group, and $R^1$ is selected from (C1-C12) alkyl, (C6-C10) aryl and (C7-C12) arylalkyl.

23. A reaction mixture comprising a ketoreductase enzyme according to claim 1, a cofactor for said ketoreductase enzyme and a substrate according to structural formula (IIa):

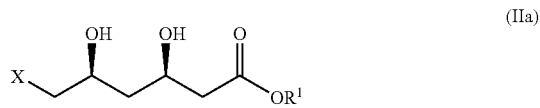

wherein X is selected from halo, cyano and —$OR^6$, where $R^6$ is hydrogen or a protecting group, and $R^1$ is selected from (C1-C12) alkyl, (C6-C10) aryl and (C7-C12) arylalkyl.

24. The mixture of claim 22 or 23 in which the weight ratio of the 5-hydroxy-3-oxohexanoate compound of structural formula (Ia) or (IIa) to the ketoreductase enzyme is in the range of about 10:1 to 200:1.

25. The mixture of claim 22 or 23 in which X is selected from chloro, cyano and hydroxyl, and in which $R^1$ is a lower alkanyl or t-butyl.

26. The mixture of claim 22 or 23 in which the cofactor is NADH and/or NADPH, and in which the weight ratio of the cofactor to the ketoreductase enzyme is in the range of about 10:1 to 100:1.

27. The mixture of claim 22 or 23 further comprising a cofactor regeneration system.

28. The mixture of claim 27 in which the cofactor regenerating system comprises glucose dehydrogenase and glucose; formate dehydrogenase and formate; or isopropanol and a secondary alcohol dehydrogenase.

29. The mixture of claim 28 wherein the secondary alcohol dehydrogenase is the ketoreductase.

30. In a method of synthesizing a statin compound that includes as one step the enantioselective reduction of a compound according to structural formula (Ia) to yield a compound according to structural formula (IIa), the improvement comprising carrying out the enantioselective reduction of compound (Ia) to compound (IIa) with a ketoreductase enzyme according to claim 1;

wherein structural formula (Ia) is:

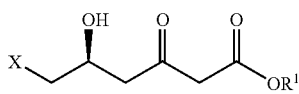
(Ia)

wherein X is selected from halo, cyano and —OR⁶, where R⁶ is hydrogen or a protecting group, and R¹ is selected from (C1-C12) alkyl, (C6-C10) aryl and (C7-C12) arylalkyl; and wherein structural formula (IIa) is:

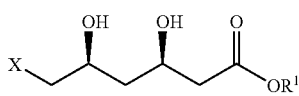
(IIa)

wherein X and R¹ are defined as for structural formula (Ia).

31. The method of claim 30 in which the statin is selected from atorvastatin, rosuvastatin, and pitavastatin.

32. A process for the preparation of a protected syn 3,5-dihydroxy-3-oxohexanoate compound according to structural formula (IIIa):

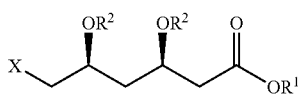
(IIIa)

wherein:
X is selected from halo, cyano and —OR⁶, where R⁶ is hydrogen or a protecting group;
R¹ is selected from (C1-C12) alkyl, (C6-C10) aryl and (C7-C12) arylalkyl; and
each R² is a protecting group, or, alternatively, the R² groups may be taken together to form an alkylene bridge of the formula —CR³R⁴—, or a boronate of —BR⁵— wherein R³ and R⁴ are each, independently of one another, selected from hydrogen, (C1-C12) alkyl, (C6-C10) aryl and (C7-C12) arylalkyl, or alternatively, R³ and R⁴ taken together form a (C4-C10) cycloalkyl or heterocycloalkyl, and R⁵ is selected from (C1-C12) alkyl, (C6-C10) aryl and (C7-C12) arylalkyl, comprising the steps of:

(i) stereoselectively reducing a 5-hydroxy-3-oxohexanoate enantiomer of structural formula (Ia) wherein structural formula (Ia) is:

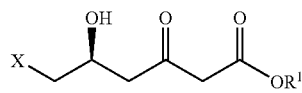
(Ia)

wherein X is selected from halo, cyano and —OR⁶, where R⁶ is hydrogen or a protecting group, and R¹ is selected from (C1-C12) alkyl, (C6-C10) aryl and (C7-C12) arylalkyl;

using a ketoreductase enzyme according to claim 1 under conditions suitable to reduce the 3-oxo group to a 3-hydroxy group to yield a first reaction product comprising a syn 3,5-dihydroxyhexanoate compound according to structural formula (IIa)

wherein structural formula (IIa) is:

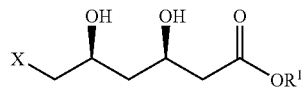
(IIa)

wherein X and R¹ are defined as for structural formula (Ia); and (ii) protecting the hydroxyl groups of the syn 3,5-dihydroxyhexanoate compound to yield a second reaction product comprising the protected syn 3,5-dihydroxy-3-oxohexanoate compound according to structural formula (IIa).

33. The process of claim 32 in which R³ and R⁴ are each methyl.

34. The process of claim 32 in which X is selected from chloro, cyano and hydroxy.

35. The process of claim 32 in which R¹ is a lower alkanyl.

36. The process of claim 35 in which R¹ is t-butyl.

37. The process of claim 34 in which X is chloro.

38. The process of claim 34 in which X is cyano.

39. The process of claim 34 in which X is hydroxy.

* * * * *